US011723967B2

(12) United States Patent
Petsch et al.

(10) Patent No.: US 11,723,967 B2
(45) Date of Patent: Aug. 15, 2023

(54) ZIKA VIRUS VACCINE

(71) Applicants: CureVac SE, Tübingen (DE); Sanofi Pasteur, Lyons (FR)

(72) Inventors: Benjamin Petsch, Tübingen (DE); Edith Jasny, Stuttgart (DE); Yves Girerd-Chambaz, Messimy (FR)

(73) Assignees: CureVac SE, Tübingen (DE); Sanofi Pasteur, Lyons (FR)

( * ) Notice: Subject to any disclaimer, the term of this patent is extended or adjusted under 35 U.S.C. 154(b) by 1399 days.

(21) Appl. No.: 15/999,469

(22) PCT Filed: Feb. 17, 2017

(86) PCT No.: PCT/EP2017/053721
§ 371 (c)(1),
(2) Date: Aug. 17, 2018

(87) PCT Pub. No.: WO2017/140905
PCT Pub. Date: Aug. 24, 2017

(65) Prior Publication Data
US 2021/0205434 A1    Jul. 8, 2021

(30) Foreign Application Priority Data
Feb. 17, 2016    (WO) .................. PCT/EP2016/053398

(51) Int. Cl.
A61K 39/12      (2006.01)
A61K 47/64      (2017.01)
A61P 31/14      (2006.01)
A61K 39/385     (2006.01)
C07K 14/005     (2006.01)

(52) U.S. Cl.
CPC ............ *A61K 39/12* (2013.01); *A61K 39/385* (2013.01); *A61K 47/646* (2017.08); *A61K 47/6455* (2017.08); *A61P 31/14* (2018.01); *C07K 14/005* (2013.01)

(58) Field of Classification Search
None
See application file for complete search history.

(56) References Cited

U.S. PATENT DOCUMENTS

| | | | |
|---|---|---|---|
| 8,691,961 | B1 | 4/2014 | Puffer et al. |
| 2005/0032730 | A1 | 2/2005 | von der Mülbe et al. |
| 2005/0059624 | A1 | 3/2005 | Hoerr et al. |
| 2005/0250723 | A1 | 11/2005 | Hoerr et al. |
| 2006/0188490 | A1 | 8/2006 | Hoerr et al. |
| 2008/0025944 | A1 | 1/2008 | Hoerr et al. |
| 2008/0267873 | A1 | 10/2008 | Hoerr et al. |
| 2009/0324584 | A1 | 12/2009 | Hoerr et al. |
| 2010/0048883 | A1 | 2/2010 | Ketterer et al. |
| 2010/0189729 | A1 | 7/2010 | Hoerr et al. |
| 2010/0203076 | A1 | 8/2010 | Fotin-Mleczek et al. |
| 2010/0291156 | A1 | 11/2010 | Barner et al. |
| 2010/0305196 | A1 | 12/2010 | Probst et al. |
| 2011/0053829 | A1 | 3/2011 | Baumhof et al. |
| 2011/0250225 | A1 | 10/2011 | Fotin-Mleczek et al. |
| 2012/0021043 | A1 | 1/2012 | Kramps et al. |
| 2012/0258046 | A1 | 10/2012 | Mutzke |
| 2013/0129754 | A1 | 5/2013 | Thess et al. |
| 2013/0142818 | A1 | 6/2013 | Baumhof et al. |
| 2013/0259879 | A1 | 10/2013 | Baumhof et al. |
| 2013/0280283 | A1 | 10/2013 | Lorenz et al. |
| 2013/0295043 | A1 | 11/2013 | Kallen et al. |
| 2013/0336998 | A1 | 12/2013 | Kallen et al. |
| 2015/0037326 | A1 | 2/2015 | Butler-Ransohoff et al. |
| 2015/0050302 | A1 | 2/2015 | Thess |
| 2015/0057340 | A1 | 2/2015 | Thess et al. |
| 2015/0093413 | A1 | 4/2015 | Thess et al. |
| 2015/0118183 | A1 | 4/2015 | Baumhof |
| 2015/0118264 | A1 | 4/2015 | Baumhof et al. |
| 2015/0165006 | A1 | 6/2015 | Thess et al. |
| 2015/0184195 | A1 | 7/2015 | Thess et al. |
| 2015/0218554 | A1 | 8/2015 | Thess |
| 2015/0306249 | A1 | 10/2015 | Baumhof et al. |
| 2015/0320847 | A1 | 11/2015 | Thess et al. |

(Continued)

FOREIGN PATENT DOCUMENTS

WO    WO 2012/019630    2/2012
WO    WO 2013/143700    10/2013

(Continued)

OTHER PUBLICATIONS

Hsieh et al., Virology 374 (2008) 338-350 (Year: 2008).*
SEQ # 552 comparison 2021 (Year: 2021).*
Prior art sequence comparison (Year: 2022).*
Database EMBL (Online), Zika virus isolate Z1106033 polyprotein gene, complete eds., XP002763497, retrieved from EBI accession No. EMBL:KU312312 polyprotein Z1106033—Suriname (complete CDS)(aa and nt), Jan. 15, 2016.
Database EMBL (Online), Zika virus partial polyprotein, XP002763498, retrieved from EBI accession No. EMBL:ALX35662, Z1106027 Suriname pos. 1-640 (C-prME-NS1 ), RNA, Jan. 15, 2016.
Database EMBL (Online), Zika virus strain Natal RGN, complete genome, XP002763505, retrieved from EBI accession No. EMBL:KU527068 Database accession No. KU527068, Feb. 12, 2016.

(Continued)

*Primary Examiner* — Shanon A. Foley
*Assistant Examiner* — Myron G Hill
(74) *Attorney, Agent, or Firm* — Parker Highlander PLLC

(57) ABSTRACT

The present invention is directed to an artificial nucleic acid and to polypeptides suitable for use in treatment or prophylaxis of an infection with Zika virus or a disorder related to such an infection. In particular, the present invention concerns a Zika virus vaccine. The present invention is directed to an artificial nucleic acid, polypeptides, compositions and vaccines comprising the artificial nucleic acid or the polypeptides. The invention further concerns a method of treating or preventing a disorder or a disease, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

15 Claims, 9 Drawing Sheets
Specification includes a Sequence Listing.

(56) References Cited

U.S. PATENT DOCUMENTS

| | | |
|---|---|---|
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2017/0354729 A1* | 12/2017 | Liu ................ C07K 14/005 |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0358314 A1 | 11/2019 | Weissman et al. |
| 2019/0374633 A1* | 12/2019 | Graham ................ G01N 33/536 |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1 | 2/2021 | Petsch et al. |
| 2021/0069315 A1 | 3/2021 | Baumhof et al. |
| 2021/0162037 A1 | 6/2021 | Jasny et al. |
| 2021/0170017 A1 | 6/2021 | Lutz et al. |
| 2021/0180106 A1 | 6/2021 | Wochner et al. |
| 2021/0205434 A1 | 7/2021 | Petsch et al. |
| 2021/0222178 A1 | 7/2021 | Linke et al. |
| 2021/0261897 A1 | 8/2021 | Yazdan Panah et al. |
| 2021/0361761 A1 | 11/2021 | Lutz et al. |
| 2021/0379181 A1 | 12/2021 | Rauch et al. |
| 2021/0403925 A1 | 12/2021 | Chevessier-Tünnesen et al. |
| 2022/0040281 A1 | 2/2022 | Schwendt et al. |
| 2022/0073962 A1 | 3/2022 | Schwenger et al. |

FOREIGN PATENT DOCUMENTS

| | | | |
|---|---|---|---|
| WO | WO-2013143700 A2 * | 10/2013 | ............ C12N 15/67 |
| WO | WO 2016/210127 | 12/2016 | |
| WO | WO 2017/015463 | 1/2017 | |
| WO | WO 2017/021546 | 2/2017 | |
| WO | WO 2017/025447 | 2/2017 | |
| WO | WO 2017/064146 | 4/2017 | |
| WO | WO 2017/070624 | 4/2017 | |
| WO | WO 2017/081110 | 5/2017 | |
| WO | WO 2017/137095 | 8/2017 | |
| WO | WO 2017/162297 | 9/2017 | |
| WO | WO 2017/182634 | 10/2017 | |
| WO | WO 2017/186928 | 11/2017 | |
| WO | WO 2017/191258 | 11/2017 | |
| WO | WO 2017/191274 | 11/2017 | |
| WO | WO 2017/203008 | 11/2017 | |
| WO | WO 2017/212006 | 12/2017 | |
| WO | WO 2017/212007 | 12/2017 | |
| WO | WO 2017/212008 | 12/2017 | |
| WO | WO 2017/212009 | 12/2017 | |
| WO | WO 2018/033254 | 2/2018 | |
| WO | WO 2018/078053 | 5/2018 | |
| WO | WO 2021-211343 | 10/2021 | |

OTHER PUBLICATIONS

Database Protein (Online), Flavivirus polyprotein (Zika virus), XP002763506, retrieved from NCBI, Database accession No. YP 002790881, full polyprotein sequence of MR766—Uganda, Feb. 8, 2016.

De Melo Freire et al., "Spread of the pandemic Zika virus lineage is associated with NS1 codon usage adaptation in humans", *bioRxiv*, preprint, pp. 1-8, Nov. 25, 2015.

Enfissi et al., "Zika virus genome from the Americas", *Lancet*, 387(10015):227-228, 2016.

International Preliminary Report on Patentability issued in corresponding PCT Application No. PCT/EP2017/053721, dated Aug. 21, 2018.

International Search Report and Written Opinion issued in corresponding PCT Application No. PCT/EP2017/053721, dated Jun. 26, 2017.

Koraka et al., "Bioinformatics in New Generation Flavivirus Vaccines", *J. Biomed. Biotechnol.*, 9(5):864029, 2010.

Kuno et al., "Full-length sequencing and genomic characterization of Bagaza, Kedougou, and Zika viruses", *Arch. Virol.*, 152(4):687-696, 2007.

Larocca et al., "Vaccine protection against Zika virus from Brazil", *Nature*, 536(7617):474-478, 2016.

Mlakar et al., "Zika Virus Associated with Microcephaly", *New Engl. J. Med.*, 374(10):951-958, 2016.

Pardi et al., "Zika virus protection by a single low-dose nucleoside-modified mRNA vaccination", *Nature*, 543(7644):248-251, 2017.

Schlake et al., "Developing mRNA-vaccine technologies", *RNA Biol.*, 9(11):1319-1330, 2012.

Chahal et al., "An RNA nanoparticle vaccine against Zika virus elicits antibody and CD8+ T cell responses in a mouse model," *Scientific Reports*, 7(1):252, 2017.

Khalil et al., "A tetravalent alphavirus-vector based dengue vaccine provides effective immunity in an early life mouse model," *Vaccine*, 32(32):4068-4074, 2014.

* cited by examiner

A

| | Mice ID | d49 (UTMB PRNT$_{50}$) |
|---|---|---|
| Setup B | 981020015708203 | - |
| | 981020015735588 | >640 |
| | 981020015741736 | 20 |
| | 981020017179912 | >640 |
| | 981020017229892 | - |
| | 981020017230170 | >640 |
| | 981020019032673 | 20 |
| | 981020019041510 | 20 |
| Setup C | 981020015706187 | 20 |
| | 981020015732879 | 20 |
| | 981020017189625 | 20 |
| | 981020017208291 | - |
| | 981020017218359 | - |
| | 981020017227098 | - |
| | 981020017635042 | 20 |
| | 981020019008930 | - |

B

| NHP ID | d1 | d29 | d57 | d78 |
|---|---|---|---|---|
| D1 | - | - | 20 | 2065 |
| D2 | - | - | 512 | 592 |
| D3 | - | - | 83 | 2554 |
| D4 | - | - | 35 | 136 |

ZIKA VIRUS VACCINE

This application is a national phase application under 35 U.S.C. § 371 of International Application No. PCT/EP2017/053721, filed Feb. 17, 2017, which claims benefit of International Application No. PCT/EP2016/053398, filed Feb. 17, 2016, the entire contents of each of which are hereby incorporated by reference.

The present invention is directed to an artificial nucleic acid and to polypeptides suitable for use in treatment or prophylaxis of an infection with Zika virus or a disorder related to such an infection. In particular, the present invention concerns a Zika virus vaccine. The present invention is directed to an artificial nucleic acid, polypeptides, compositions and vaccines comprising the artificial nucleic acid or the polypeptides. The invention further concerns a method of treating or preventing a disorder or a disease, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

Zika virus is an arbovirus belonging to the Flaviviridae family. It is a member of the Spondweni serocomplex and is related to yellow fever virus, dengue fever virus, West Nile virus and Japanese encephalitis virus. Like other members of the Flavivirus genus, Zika virus contains a positive, single-stranded genomic RNA encoding a polyprotein that is processed into several structural and non-structural proteins. Virus replication occurs in the cellular cytoplasm.

Zika virus was first isolated from a sentinel rhesus monkey placed in Zika forest, Uganda, in 1947. Until a few years ago, Zika virus received very little attention on a global scale, as it was confined to a narrow equatorial belt running across Africa and into Asia. However, after large outbreaks in French Polynesia in 2013 and in Brazil, Colombia and Cape Verde in 2015, Zika virus is by now perceived as an emerging pathogen. The current explosive pandemic in the larger part of South and Central America even led the WHO to declare that the spread of Zika virus constitutes a 'Public Health Emergency of International Concern'.

In humans, infection with Zika virus typically leads to dengue-like disease with symptoms such as fever, muscle aches, eye pain, prostration and maculopapular rash. Until now, no cases of hemorrhagic fever have been observed. However, there is a strong association, in time and place, between the number of Zika virus infections and the incidence of congenital malformations and neurological complications. In particular, it is suspected that Zika infection during pregnancy may lead to microencephaly in newborns. Moreover, an increased number of cases of Guillain-Barré-Syndrome was registered during Zika virus epidemics.

At present, there is no specific treatment of Zika virus infections. Therapy is limited to curing the symptoms caused by the infection. In addition, there is currently no vaccine available against Zika virus infections. There is therefore a strong need for a vaccine against Zika virus infection.

The underlying object of the present invention is therefore to provide a Zika virus vaccine. It is a further preferred object of the invention to provide a Zika virus vaccine, preferably an improved Zika virus vaccine, which may be produced at an industrial scale. A further object of the present invention is the provision of a storage-stable Zika vaccine.

The object underlying the present invention is solved by the claimed subject-matter.

The present invention was made with support from the Government under Agreement No. HR0011-11-3-0001 awarded by DARPA. The Government has certain rights in the invention.

The present application is filed together with a sequence listing in electronic format, which is part of the description of the present application. The information contained in the electronic format of the sequence listing filed together with this application is incorporated herein by reference in its entirety. Where reference is made herein to a 'SEQ ID NO:' the corresponding nucleic acid sequence or amino acid sequence in the sequence listing having the respective identifier is referred to.

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid molecule, preferably an mRNA as defined herein. In this context, also fragments, variants and derivatives of peptides and proteins comprising at least one epitope are understood as antigens. In the context of the present invention, tumour antigens and pathogenic antigens as defined herein are particularly preferred.

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) coding regions. A coding region in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. A 5'cap structure may be introduced into a nucleic acid, for example, by providing the respective nucleotides during transcription ("co-translational capping") or by enzymatically capping a nucleic acid, such as an RNA.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens.

Further characteristics may be activation of macrophages and natural killer cells, enabling them to destroy pathogens and stimulation of cells to secrete a variety of cytokines that influence the function of other cells involved in adaptive immune responses and innate immune responses.

Cloning site: A cloning site is typically understood to be a segment of a nucleic acid molecule, which is suitable for insertion of a nucleic acid sequence, e.g., a nucleic acid sequence comprising a coding region. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Coding region: A coding region, in the context of the invention, is typically a sequence of several nucleotide triplets, which may be translated into a peptide or protein. A coding region preferably contains a start codon, i.e. a combination of three subsequent nucleotides coding usually for the amino acid methionine (ATG), at its 5'-end and a subsequent region which usually exhibits a length which is a multiple of 3 nucleotides. A coding region is preferably terminated by a stop-codon (e.g., TAA, TAG, TGA). Typically, this is the only stop-codon of the coding region. Thus, a coding region in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding region may be isolated or it may be incorporated in a longer nucleic acid sequence, for example in a vector or an mRNA. In the context of the present invention, a coding region may also be termed "protein coding region", "coding sequence", "CDS", "open reading frame" or "ORF".

The phrase "derived from" as used throughout the present specification in the context of a nucleic acid, i.e. for a nucleic acid "derived from" (another) nucleic acid, means that the nucleic acid, which is derived from (another) nucleic acid, shares at least 50%, preferably at least 60%, preferably at least 70%, more preferably at least 75%, more preferably at least 80%, more preferably at least 85%, even more preferably at least 90%, even more preferably at least 95%, and particularly preferably at least 98% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the thymidines (T) by uracils (U) throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. It goes without saying that such modifications are preferred, which do not impair RNA stability, e.g. in comparison to the nucleic acid from which it is derived.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Epitope: (also called "antigen determinant") can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) molecule from which the fragment is derived. Preferably, a fragment of a sequence as used herein is at least 5%, 10%, 20%, 30%, 40%, 50%, 60%, preferably at least 70%, more preferably at least 80%, even more preferably at least 90%, most preferably at least 95% identical to a sequence, from which it is derived.

G/C modified: A G/C-modified nucleic acid may typically be a nucleic acid, preferably an artificial nucleic acid molecule as defined herein, based on a modified wild-type sequence comprising a preferably increased number of guanosine and/or cytosine nucleotides as compared to the wild-type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Heterologous sequence: Two sequences are typically understood to be 'heterologous' if they are not derivable from the same gene or in the same allele. I.e., although heterologous sequences may be derivable from the same organism, they naturally (in nature) do not occur in the same nucleic acid molecule, such as in the same mRNA.

Homolog of a nucleic acid sequence: The term "homolog" of a nucleic acid sequence refers to sequences of other species than the particular sequence. It is particularly preferred that the nucleic acid sequence is of human origin and therefore it is preferred that the homolog is a homolog of a human nucleic acid sequence.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component which is able to induce an immune response is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have a coding region and thus does not provide a peptide-antigen or immunogen but elicits an immune response e.g. by binding to a specific kind of Toll-like-receptor (TLR) or other suitable receptors. However, of course also mRNAs having a coding region and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide".

Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Nucleic acid sequence/amino acid: The sequence of a nucleic acid molecule is typically understood to be the particular and individual order, i.e. the succession of its nucleotides. The sequence of a protein or peptide is typically understood to be the order, i.e. the succession of its amino acids.

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units. The term 'polypeptide' as used herein, however, is typically not limited by the length of the molecule it refers to. In the context of the present invention, the term 'polypeptide' may also be used with respect to peptides comprising less than 50 (e.g. 10) amino acids or peptides comprising even more than 600 amino acids.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. A poly(A) sequence is typically located at the 3'end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different post-transcriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, a coding region, a 3'-UTR and a poly(A) sequence. Aside from messenger RNA, several non-coding types of RNA exist which may be involved in regulation of transcription and/or translation.

Sequence identity: Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. Hence, in the context of the present invention, identity of sequences preferably relates to the percentage of nucleotides of a sequence which have the same position in two or more sequences having the same length. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the body's adaptive immune system to provide an adaptive immune response.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising a coding region. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding region and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound.

3'-untranslated region (3'-UTR): Generally, the term "3'-UTR" refers to a part of the artificial nucleic acid molecule, which is located 3' (i.e. "downstream") of a coding region and which is not translated into protein. Typically, a 3'-UTR is the part of an mRNA which is located between the protein coding region (coding region or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA which is located between the the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. Preferably, the 3'UTRs have a length of more than 20, 30, 40 or 50 nucleotides.

5'-untranslated region (5'-UTR): Generally, the term "5'-UTR" refers to a part of the artificial nucleic acid molecule, which is located 5' (i.e. "upstream") of a coding region and which is not translated into protein. A 5'-UTR is typically understood to be a particular section of messenger RNA (mRNA), which is located 5' of the coding region of the mRNA. Typically, the 5'-UTR starts with the transcriptional start site and ends one nucleotide before the start codon of the coding region. Preferably, the 5'UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be posttranscriptionally modified, for example by addition of a 5'-CAP. A 5'-UTR of the mRNA is not translated into an amino acid sequence. The 5'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 5'-UTR corresponds to the sequence of a mature mRNA which is located between the start codon and, for example, the 5'-CAP. Preferably, the 5'-UTR corresponds to the sequence which extends from a nucleotide located 3' to the 5'-CAP, more preferably from the nucleotide located immediately 3' to the 5'-CAP, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene" is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence (both sense and antisense strand and both mature and immature) of the 5'-UTR.

5'Terminal Oliqopyrimidine Tract (TOP): The 5'terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5'terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'end with a cytosine nucleotide. In TOP genes and TOP mRNAs, the TOP-motif preferably starts at its 5'end with the transcriptional start site and ends one nucleotide 5' to the first purin residue in said gene or mRNA. A TOP motif in the sense of the present invention is preferably located at the 5'end of a sequence which represents a 5'-UTR or at the 5'end of a sequence which codes for a 5'-UTR. Thus, preferably, a stretch of 3 or more pyrimidine nucleotides is called "TOP motif" in the sense of the present invention if this stretch is located at the 5'end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-CAP to the nucleotide located 5' to the start codon. A 5'-UTR of a TOP gene typically does not comprise any start codons, preferably no upstream AUGs (uAUGs) or upstream coding regions (uORFs). Therein, upstream AUGs and upstream coding regions are typically understood to be AUGs and coding regions that occur 5' of the start codon (AUG) of the coding region that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID Nos. 1-1363 of the patent application WO2013/143700, whose disclosure is incorporated herewith by reference. In this context a particularly preferred fragment of a 5'-UTR of a TOP gene is a 5'-UTR of a TOP gene lacking the 5'TOP motif. The terms "5'-UTR of a TOP gene" or "5'-TOP UTR" preferably refer to the 5'-UTR of a naturally occurring TOP gene.

In a first aspect, the invention relates to an artificial nucleic acid comprising at least one coding region encoding at least one polypeptide comprising or consisting of at least one Zika virus protein, or a fragment or variant thereof.

In particular, the invention relates to an artificial nucleic acid comprising or consisting of at least one coding region encoding at least one polypeptide comprising or consisting of at least one protein selected from the group consisting of Zika virus capsid protein (C), Zika virus premembrane protein (prM), Zika virus pr protein, Zika virus membrane protein (M), Zika virus envelope protein (E) and a Zika virus non-structural protein, such as NS1, NS2A, NS2B, NS3, NS4A, NS4B or NS5, or a fragment or variant of any of these proteins.

The present invention is based on the surprising finding that the at least one Zika virus protein comprised in the at least one polypeptide encoded by the artificial nucleic acid as described herein can efficiently be expressed in a mammalian cell. It was further unexpectedly found that the artificial nucleic acid is suitable for eliciting an immune response against Zika virus in a subject.

In the context of the present invention, the term 'Zika virus' comprises any Zika virus, irrespective of strain or origin. Preferably, the term relates to a Zika virus from an African or an Asian lineage. More preferably, the term 'Zika virus' comprises a Zika virus strain selected from the group consisting of ZikaSPH2015-Brazil, Z1106033-Suriname and MR766-Uganda. Preferably the term 'Zika virus' as used herein refers to Zika virus strain ZikaSPH2015-Brazil, which preferably corresponds to GenBank-ID's KU321639.1 and ALU33341.1. Furthermore, the term 'Zika virus' as used herein may refer to Zika virus strain Z1106033-Suriname, which preferably corresponds to GenBank-ID's KU312312.1 and ALX35659.1. The term 'Zika virus' as used herein may also refer to Zika virus strain MR766-Uganda, which preferably corresponds to GenBank-ID's AY632535.2 and AAV34151.1.

The term 'Zika virus' as used herein is not limited to a specific strain or to a virus of a specific origin. The term 'Zika virus' comprises any strain or isolate of Zika virus. In preferred embodiments of the invention, the term 'Zika virus' refers a Zika virus strain selected from the group consisting of ZikaSPH2015-Brazil, Z1106033-Suriname, MR766-Uganda and Natal RGN. In a preferred embodiment, the term 'Zika virus' as used herein refers to a Zika virus of strain Natal RGN, preferably corresponding to GenBank-ID KU527068.1.

The at least one polypeptide encoded by the at least one coding region of the inventive artificial nucleic acid comprises at least one Zika virus protein. The RNA genome of Zika virus typically encodes a plurality of structural and non-structural proteins. Translation of Zika virus RNA typically leads to a precursor protein comprising a plurality of individual viral (structural and non-structural) proteins (or precursor of these proteins) in one polypeptide chain, which is typically referred to as 'polyprotein' or 'precursor protein'.

For example, a Zika virus polyprotein from Zika virus strain ZikaSPH2015-Brazil preferably comprises or consists of an amino acid sequence according to SEQ ID NO: 1 or an amino acid sequence according to GenBank-ID ALU33341.1. Further, a Zika virus polyprotein from Zika virus strain Z1106033-Suriname preferably comprises or consists of an amino acid sequence according to SEQ ID NO: 18 or an amino acid sequence according to GenBank-ID ALX35659.1. Moreover, a Zika virus polyprotein from Zika virus strain MR766-Uganda preferably comprises or consists of an amino acid sequence according to SEQ ID NO: 35 or an amino acid sequence according to GenBank-ID AAV34151.1.

In the context of the present invention, a Zika virus polyprotein typically comprises amino acid sequences that are target sites for enzymes that specifically cleave the polyprotein in order to yield fragments of the polyprotein, wherein the fragments preferably comprise an individual Zika virus protein or two or more Zika virus proteins, or a fragment or variant thereof. In the context of the present invention, the term 'polyprotein' may also refer to a polypeptide chain comprising the amino acid sequences of at least two individual Zika virus proteins, or a fragment or variant thereof. Cleavage of a Zika virus polyprotein preferably occurs between individual Zika virus proteins (e.g. between the capsid protein (C) and the premembrane protein (prM)), or fragments or variants thereof. An individual Zika virus protein, or a fragment or variant thereof, e.g. as obtained from a polyprotein by cleavage, is preferably referred to as 'mature Zika virus protein'. In the context of the present invention, the term 'mature Zika virus protein' is not limited to an individual Zika virus protein, or a fragment or variant thereof, which was generated by cleavage of a polyprotein, but also comprises an individual Zika virus protein of another origin, such as an individual Zika virus protein expressed recombinantly from an artificial nucleic acid. Preferably, a mature Zika virus protein lacks an amino acid sequence that is typically present in a corresponding amino acid sequence encoding said Zika virus protein in a Zika virus polyprotein (precursor protein) and wherein said amino acid sequence lacking in the mature Zika virus protein preferably corresponds to an amino acid sequence, which is usually removed by cleavage during processing of a Zika virus polyprotein. For example, an amino acid sequence, which is a target site for a protease, may be present in a Zika virus polyprotein, but may be absent from a mature Zika virus protein derived from said Zika virus polyprotein.

In the context of the present invention, the term 'Zika virus protein' may refer to any amino acid encoded by a Zika virus nucleic acid. For example, a 'Zika virus protein' may be any polypeptide comprising or consisting of an amino acid sequence according to any one of the following amino acid sequences from GenBank, or a fragment or variant of any of these sequences: YP_009227209.1, YP_009227208.1, YP_009227207.1, YP_009227206.1, YP_009227205.1, YP_009227204.1, YP_009227203.1, YP_009227202.1, YP_009227201.1, YP_009227200.1, YP_009227199.1, YP_009227198.1, YP_009227197.1, YP_009227196.1, YP_002790881.1, AMD61711.1, AMD61710.1, AMC33116.1, AMC39589.1, AMC37201.1, AMC37200.1, AMC13913.1, AMC13912.1, AMC13911.1, AMB37295.1, AMA12087.1, AMA12086.1, AMA12085.1, AMA12084.1, ALY05362.1, ALX35662.1, ALX35661.1, ALX35660.1, ALX35659.1, ALU33341.1, AHF49785.1, AHF49784.1, AHF49783.1, AJD79051.1, AJD79050.1, AJD79049.1, AJD79048.1, AJD79047.1, AJD79046.1, AJD79045.1, AJD79044.1, AJD79043.1, AJD79042.1, AJD79041.1, AJD79040.1, AJD79039.1, AJD79038.1, AJD79037.1, AJD79036.1, AJD79035.1, AJD79034.1, AJD79033.1, AJD79032.1, AJD79031.1, AJD79030.1, AJD79029.1, AJD79028.1, AJD79027.1, AJD79026.1, AJD79025.1, AJD79024.1, AJD79023.1, AJD79022.1, AJD79021.1, AJD79020.1, AJD79019.1, AJD79018.1, AJD79017.1, AJD79016.1, AJD79015.1, AJD79014.1, AJD79013.1, AJD79012.1, AJD79011.1, AJD79010.1, AJD79009.1, AJD79008.1, AJD79007.1, AJD79006.1, AJD79005.1, AJD79004.1, AJD79003.1, AJD79002.1, AJD79001.1, AKD44140.1, AKD44139.1, ALI57109.1, ALI57108.1, ALI57107.1, ALI57106.1, AKH87423.1, AKN44264.1, AKN44263.1, AKH87424.1, AJA06126.1, AJD81427.1, AJD81426.1, AJD81425.1, AJD81424.1, AJD81423.1, AJD81421.1, AJA40024.1, AJA40023.1, AHL37808.1, BAP47441.1, AHZ08798.1, AHZ13508.1, AIC06934.1, AIA09362.1, AIA09361.1, AHX00706.1, AHX00705.1, AHL43505.1, AHL43504.1, AHL43503.1, AHL43502.1, AHL43501.1, AHL43500.1, AHL43499.1, AHL43498.1, AHL43497.1, AHL43496.1, AHL43495.1, AHL43494.1, AHL43493.1, AHL43492.1, AHL43491.1, AHL43490.1, AHL43489.1, AHL43488.1, AHL43487.1, AHL43486.1, AHL43485.1, AHL43484.1, AHL43483.1, AHL43482.1, AHL43481.1, AHL43480.1, AHL43479.1, AHL43478.1, AHL43477.1, AHL43476.1, AHL43475.1, AHL43474.1, AHL43473.1, AHL43472.1, AHL43471.1, AHL43470.1, AHL43469.1, AHL43468.1, AHL43467.1, AHL43466.1, AHL43465.1, AHL43464.1, AHL43463.1, AHL43462.1, AHL43461.1, AHL43460.1, AHL43459.1, AHL43458.1, AHL43457.1, AHL43456.1, AHL43455.1, AHL43454.1, AHL43453.1, AHL43452.1, AHL43451.1, AHL43450.1, AHL43449.1, AHL43448.1, AHL43447.1, AHL43446.1, AHL43445.1, AHL43444.1, AHL43443.1, AHL43442.1, AHL43441.1, AHL43440.1, AHL43439.1, AHL43438.1, AHL43437.1, AHL16750.1, AHL16749.1, BA049790.1, AGS07298.1, AFD30972.1, AEN75266.1, AEN75265.1, AEN75264.1, AEN75263.1, AAC58803.1, ABY86749.1, AAV34151.1, AAK91609.1, ABW77724.1, ABI54475.1 or ACD75819.1. A 'Zika virus protein' as used herein may further be an amino acid sequence encoded by any one of the following nucleic acid sequences from GenBank, or a fragment or variant of any of the encoded amino acid sequences: NC_012532.1, KU681082.1, KU681081.1, KU647676.1, KU556802.1, KU509998.1, KU646828.1, KU646827.1, KU501217.1, KU501216.1, KU501215.1, KU365780.1, KU365779.1, KU365778.1, KU365777.1, KT200609.1, KU312315.1, KU312314.1, KU312313.1, KU312312.1, LG018115.1, KU321639.1, KF268950.1, KF268949.1, KF268948.1, KM078979.1, KM078978.1, KM078977.1, KM078976.1, KM078975.1, KM078974.1, KM078973.1, KrV1078972.1, KM078971.1, KM078970.1, KM078969.1, KM078968.1, KM078967.1, KM078966.1, KM078965.1, KM078964.1, KM078963.1, KM078962.1, KM078961.1, KM078960.1, KM078959.1, KM078958.1, KM078957.1, KM078956.1, KM078955.1, KM078954.1, KM078953.1, KM078952.1, KM078951.1, KM078950.1, KM078949.1, KM078948.1, KM078947.1, KM078946.1, KM078945.1, KM078944.1, KM078943.1, KM078942.1, KM078941.1, KM078940.1, KM078939.1, KM078938.1, KM078937.1, KM078936.1, KM078935.1, KM078934.1, KM078933.1, KM078932.1, KM078931.1, KM078930.1, KM078929.1, KP099610.1, KP099609.1, KR816336.1, KR816335.1, KR816334.1, KR816333.1, HW822069.1, DI450454.1, KM851039.1, KR815990.1, KR815989.1, KM851038.1, KM014700.1, KM212967.1, KM212966.1, KM212965.1, KM212964.1, KM212963.1, KM212961.1, KJ873161.1, KJ873160.1, KF993678.1, LC002520.1, KJ461621.1, KJ776791.1, KJ634273.1, KJ579442.1, KJ579441.1, KJ680135.1, KJ680134.1, KF383121.1, KF383120.1, KF383119.1, KF383118.1, KF383117.1, KF383116.1, KF383115.1, KF383114.1, KF383113.1, KF383112.1, KF383111.1, KF383110.1, KF383109.1, KF383108.1, KF383107.1, KF383106.1, KF383105.1, KF383104.1, KF383103.1, KF383102.1, KF383101.1, KF383100.1, KF383099.1, KF383098.1, KF383097.1, KF383096.1, KF383095.1, KF383094.1, KF383093.1, KF383092.1, KF383091.1, KF383090.1, KF383089.1, KF383088.1, KF383087.1, KF383086.1, KF383085.1, KF383084.1, KF383083.1, KF383082.1, KF383081.1, KF383080.1, KF383079.1, KF383078.1, KF383077.1, KF383076.1, KF383075.1, KF383074.1, KF383073.1, KF383072.1, KF383071.1, KF383070.1, KF383069.1, KF383068.1, KF383067.1, KF383066.1, KF383065.1, KF383064.1, KF383063.1, KF383062.1, KF383061.1, KF383060.1, KF383059.1, KF383058.1, KF383057.1, KF383056.1, KF383055.1, KF383054.1, KF383053.1, KF383052.1, KF383051.1, KF383050.1, KF383049.1, KF383048.1, KF383047.1, KF383046.1, KF383045.1, KF383044.1, KF383043.1, KF383042.1, KF383041.1, KF383040.1, KF383039.1, KF383038.1, KF383037.1, KF383036.1, KF383035.1, KF383034.1, KF383033.1, KF383032.1, KF383031.1, KF383030.1, KF383029.1, KF383028.1, KF383027.1, KF383026.1, KF383025.1, KF383024.1, KF383023.1, KF383022.1, KF383021.1, KF383020.1, KF383019.1, KF383018.1, KF383017.1, KF383016.1, KF383015.1, KF270887.1, KF270886.1, AB908162.1, JC303440.1, KF258813.1, JN860885.1, HQ234501.1, HQ234500.1, HQ234499.1, HQ234498.1, AF013415.1, EU303241.1, AY632535.2, AF372422.1, EU074027.1, DQ859059.1, EU545988.1 or AY326412.1.

Alternatively, a 'Zika virus protein' may be any polypeptide comprising or consisting of an amino acid sequence according to any one of the following amino acid sequences from GenBank, or a fragment or variant of any of these sequences: 5GJ4_A, 5GJ4_B, 5GJ4_C, 5GJ4_D, 5GJ4_E, 5GJ4_F, 5GJ4_G, 5a14_H, 5GJB_A, 5GJC_A, 5GOZ_A, 5GOZ_B, 5GOZ_C, 5GP1_A, 5GP1_B, 5GP1_C, 5GPI_B, 5GPI_C, 5GPI_D, 5GPI_E, 5GPI_F, 5GPI_G, 5GPI_H, 5GS6_A, 5GS6_B, 5GZN_A, 5GZN_B, 5GZN_E, 5GZN_G, 5GZO_A, 5GZO_B, 5GZR_A, 5GZR_B, 5GZR_C, 5GZR_D, 5GZR_E, 5GZR_F, 5H30_A, 5H30_B, 5H30_C, 5H30_D, 5H30_E, 5H30_F, 5H32_A, 5H32_B, 5H32_C, 5H37_A, 5H37_B, 5H37_C, 5H37_D, 5H37_E, 5H37_F, 5H4I_A, 5H4I_B, 5IRE_A, 5IRE_B, 5IRE_C, 5IRE_D, 5IRE_E, 5IRE_F, 5IY3_A, 5IY3_B, 5IZ7A, 5IZ7_B, 5IZ7_C, 5IZ7_D, 5IZ7_E, 5IZ7_F, 5JHL_A, 5JHM_A, 5JHM_B, 5JMT_A, 5JRZ_A, 5JWH_A, 5K6K_A, 5K6K_B, 5K8I_A, 5K8L_A, 5K8T_A, 5K8U_A, 5KQR_A, 5KQS_A, 5KVD_E, 5KVE_E, 5KVF_E, 5KVG_E, 5LBS_A, 5LBS_B, 5LBV_A, 5LBV_B, 5LCO_A, 5LCO_B, 5LCV_A, 5LCV_B, 5M5B_A, 5M5B_B, 5MFX_A, 5MRK_A, 5MRK_B, 5T1V_A, 5T1V_B, 5TFR_A, 5TFR_B, 5TXG_A, 5U4W_A, 5U4W_B, 5U4W_C, 5U4W_D, 5U4W_E, 5U4W_F, 5U4W_G, 5U4W_H, 5U4W_I, 5U4W_J, 5U4W_K, 5U4W_L, AAC58803, AAK91609, AAV34151, ABI54475, ABW77724, ABY86749, ACD75819, AEN75263, AEN75264, AEN75265, AEN75266, AFD30972, AGS07298, AHF49783, AHF49784, AHF49785, AHL16749, AHL16750, AHL37808, AHL43437, AHL43438, AHL43439, AHL43440, AHL43441, AHL43442, AHL43443, AHL43444, AHL43445, AHL43446, AHL43447, AHL43448, AHL43449, AHL43450, AHL43451, AHL43452, AHL43453, AHL43454, AHL43455, AHL43456, AHL43457, AHL43458, AHL43459, AHL43460, AHL43461, AHL43462, AHL43463, AHL43464, AHL43465, AHL43466, AHL43467, AHL43468, AHL43469, AHL43470, AHL43471, AHL43472, AHL43473, AHL43474, AHL43475, AHL43476, AHL43477, AHL43478, AHL43479, AHL43480, AHL43481, AHL43482, AHL43483, AHL43484, AHL43485, AHL43486, AHL43487, AHL43488, AHL43489, AHL43490, AHL43491, AHL43492, AHL43493, AHL43494, AHL43495, AHL43496, AHL43497, AHL43498, AHL43499, AHL43500, AHL43501, AHL43502, AHL43503, AHL43504, AHL43505, AHX00705, AHX00706, AHZ08798, AHZ13508, AIA09361, AIA09362, AIC06934, AJA06126, AJA40023, AJA40024, AJD79001, AJD79002, AJD79003, AJD79004, AJD79005, AJD79006, AJD79007, AJD79008, AJD79009, AJD79010, AJD79011, AJD79012, AJD79013, AJD79014, AJD79015, AJD79016, AJD79017, AJD79018, AJD79019, AJD79020, AJD79021, AJD79022, AJD79023, AJD79024, AJD79025, AJD79026, AJD79027, AJD79028, AJD79029, AJD79030, AJD79031, AJD79032, AJD79033, AJD79034, AJD79035, AJD79036, AJD79037, AJD79038, AJD79039, AJD79040, AJD79041, AJD79042, AJD79043, AJD79044, AJD79045, AJD79046, AJD79047, AJD79048, AJD79049, AJD79050, AJD79051, AJD81421, AJD81423, AJD81424, AJD81425, AJD81426, AJD81427, AKD44139, AKD44140, AKH87423, AKH87424, AKN44263, AKN44264, ALI57106, ALI57107, ALI57108, ALI57109, ALL27019, ALU33341, ALX35659, ALX35660, ALX35661, ALX35662, ALY05362, AMA12084, AMA12085, AMA12086, AMA12087, AMB18850, AMB37295, AMC13911, AMC13912, AMC13913, AMC33116, AMC37200, AMC37201, AMC39589, AMD16557, AMD61710, AMD61711, AME17073, AME17074, AME17075, AME17076, AME17077, AME17078, AME17079, AME17080, AME17081, AME17082, AME17083, AME17084, AME17085, AME17086, AME17087, AME17706, AMH87239, AMK02027, AMK26952, AMK26953, AMK26954, AMK26955, AMK26956, AMK49164, AMK49165, AMK49492, AMK79467, AMK79468, AMK79469, AML60296, AML81019, AML81020, AML81021, AML81022, AML81023, AML81024, AML81025, AML81026, AML81027, AML81028, AML82110, AMM39804, AMM39805, AMM39806, AMM43325, AMM43326, AMM76159, AMN14619, AMN14620, AMN14621, AMN14622, AMN91947, AMO03410, AMO25682, AMP44573, AMQ34003, AMQ34004, AMQ48924, AMQ48925, AMQ48926, AMQ48927, AMQ48981, AMQ48982, AMQ48986, AMQ76459, AMQ76464, AMQ76465, AMR39829, AMR39830, AMR39831, AMR39832, AMR39833, AMR39834, AMR39835, AMR39836, AMR68905, AMR68906, AMR68932, AMR96778, AMR96779, AMS00611, AMU04506, AMU04544, AMX81918, AMX81919, AMX81920, AMX81921, AMY50629, AMY50630, AMZ03556, AMZ03557, ANA12599, ANA85187, ANA85188, ANA85189, ANA85190, ANA85191, ANA85192, ANA85193, ANA85194, ANB66182, ANB66183, ANB66184, ANC28273, ANC28274, ANC90420, ANC90421, ANC90422, ANC90423, ANC90424, ANC90425, ANC90426, ANC90427, ANC90428, AND01116, ANF04750, ANF04751, ANF04752, ANF16414, ANF28857, ANF28858, ANF28859, ANF28860, ANF28861, ANF28862, ANF28863, ANF28864, ANF28865, ANF28866, ANF28867, ANF29038, ANG09399, ANG09400, ANG09401, ANG09402, ANG09403, ANG09404, ANH10698, ANH21697, ANH22038, ANI87834, ANK57866, ANK57895, ANK57896, ANK57897, ANK57898, ANK57899, ANN44857, ANN83272, ANN83273, ANO46296, ANO46297, ANO46298, ANO46301, ANO46302, ANO46303, ANO46304, ANO46305, ANO46306, ANO46307, ANO46308, ANO46309, ANO46310, ANO46311, ANO46312, ANO46313, ANQ92019, ANS60026, ANW07474, ANW07475, ANW07476, ANW07477, ANZ46736, AOO50652, AOO50653, AOO50654, AOE22997, AOG18295, AOG18296, AOI20067, AOL02459, AOO19565, AOO53981, AOO53982, AOO53983, AOO53984, AOO85388, AOP04275, AOP04276, AOR39541, AOR51315, AOR82892, AOR82893, AOR87336, AOS90220, AOS90221, AOS90222, AOS90223, AOS90224, AOS90225, AOT82811, AOV81593, AOX24134, AOX24135, AOX49264, AOX49265, AOX49266, AOX49267, AOX49268, AOX49478, AOX49479, AOY08516, AOY08517, AOY08518, AOY08519, AOY08520, AOY08521, AOY08522, AOY08523, AOY08524, AOY08525, AOY08526, AOY08527, AOY08528, AOY08529, AOY08530, AOY08531, AOY08532, AOY08533, AOY08534, AOY08535, AOY08536, AOY08537, AOY08538, AOY08539, AOY08540, AOY08541, AOY08542, AOY08543, AOY08544, AOY08545, AOY08546, AOY08547, AOY08548, AOY10605, AOY10606, APB03017, APB03018, APB03019, APB03020, APB03021, APB03022, APB03023, APB03024, APC60215, APC60216, APH11492, APH11611, APO08503, APO08504, APO15553, APO36913, APO39228, APO39229, APO39230, APO39231, APO39232, APO39233, APO39234, APO39235, APO39236, APO39237, APO39238, APO39239, APO39240, APO39241, APO39242, APO39243, APP91860, APP91861, APP91864, APQ41782, APQ41783, APQ41784, APQ41785, APQ41786, BA049790, BAP47441, BAV32139, BAV82373, BAV89190, Q32ZE1, YP_002790881, YP_009227196, YP_009227197, YP_009227198, YP_009227199, YP_009227200, YP_009227201, YP_009227202, YP_009227203, YP_009227204, YP_009227205, YP_009227206, YP_009227207, YP_009227208 or YP_009227209. Preferably, a 'Zika virus protein' as used herein is an amino acid sequence encoded by any one of the following nucleic acid sequences from GenBank, or a fragment or variant of any of the encoded amino acid sequences: AB908162, AF013415, AF372422, AY326412, AY632535, DI450454, DQ859059, EU074027, EU303241, EU545988, HQ234498, HQ234499, HQ234500, HQ234501, HW822069, JC303440, JN860885, KF258813, KF268948, KF268949, KF268950, KF270886, KF270887, KF383015, KF383016, KF383017, KF383018, KF383019, KF383020, KF383021, KF383022, KF383023, KF383024, KF383025, KF383026, KF383027, KF383028, KF383029, KF383030, KF383031, KF383032, KF383033, KF383034, KF383035, KF383036, KF383037, KF383038, KF383039, KF383040, KF383041, KF383042, KF383043, KF383044, KF383045, KF383046, KF383047, KF383048, KF383049, KF383050, KF383051, KF383052, KF383053, KF383054, KF383055, KF383056, KF383057, KF383058, KF383059, KF383060, KF383061, KF383062, KF383063, KF383064, KF383065, KF383066, KF383067, KF383068, KF383069, KF383070, KF383071, KF383072, KF383073, KF383074, KF383075, KF383076, KF383077, KF383078, KF383079, KF383080, KF383081, KF383082, KF383083, KF383084, KF383085, KF383086, KF383087, KF383088, KF383089, KF383090, KF383091, KF383092, KF383093, KF383094, KF383095, KF383096, KF383097, KF383098, KF383099, KF383100, KF383101, KF383102, KF383103, KF383104, KF383105, KF383106, KF383107, KF383108, KF383109, KF383110, KF383111, KF383112, KF383113, KF383114, KF383115, KF383116, KF383117, KF383118, KF383119, KF383120, KF383121, KF993678, KJ461621, KJ579441, KJ579442, KJ634273, KJ680134, KJ680135, KJ776791, KJ873160, KJ873161, KM014700, KM078929, KM078930, KM078931, KM078932, KM078933, KM078934, KM078935, KM078936, KM078937, KM078938, KM078939, KM078940, KM078941, KM078942, KM078943, KM078944, KM078945, KM078946, KM078947, KM078948, KM078949, KM078950, KM078951, KM078952, KM078953, KM078954, KM078955, KM078956, KM078957, KM078958, KM078959, KM078960, KM078961, KM078962, KM078963, KM078964, KM078965, KM078966, KM078967, KM078968, KM078969, KM078970, KM078971, KM078972, KM078973, KM078974, KM078975, KM078976, KM078977, KM078978, KM078979, KM212961, KM212963, KM212964, KM212965, KM212966, KM212967, KM851038, KM851039, KP099609, KP099610, KR815989, KR815990, KR816333, KR816334, KR816335, KR816336, KR872956, KT200609, KT381874, KU179098, KU232288, KU232289, KU232290, KU232291, KU232292, KU232293, KU232294, KU232295, KU232296, KU232297, KU232298, KU232299, KU232300, KU232301, KU312312, KU312313, KU312314, KU312315, KU321639, KU365777, KU365778, KU365779, KU365780, KU497555, KU501215, KU501216, KU501217, KU509998, KU527068, KU556802, KU646827, KU646828, KU647676, KU681081, KU681082, KU686218, KU707826, KU720415, KU724096, KU724097, KU724098, KU724099, KU724100, KU729217, KU729218, KU740184, KU740199, KU744693, KU752544, KU752545, KU758868, KU758869, KU758870, KU758871, KU758872, KU758873, KU758874, KU758875, KU758876, KU758877, KU758878, KU761560, KU761561, KU761564, KU820897, KU820898, KU820899, KU844090, KU853012, KU853013, KU866423, KU867812, KU870645, KU872850, KU886298, KU922923, KU922960, KU926309, KU926310, KU926323, KU926324, KU926325, KU926326, KU937936, KU940224, KU940227, KU940228, KU954085, KU955589, KU955590, KU955591, KU955592, KU955593, KU955594, KU955595, KU963573, KU963574, KU963796, KU978616, KU985087, KU985088, KU991811, KX051563, KX056898, KX059013, KX059014, KX062044, KX062045, KX087101, KX087102, KX101060, KX101061, KX101062, KX101063, KX101064, KX101065, KX101066, KX101067, KX117076, KX156774, KX156775, KX156776, KX162585, KX162586, KX173840, KX173841, KX173842, KX173843, KX173844, KX185891, KX197192, KX197205, KX198134, KX198135, KX212103, KX216632, KX216633, KX216634, KX216635, KX216636, KX216637, KX216638, KX216639, KX216640, KX247632, KX247638, KX247646, KX253994, KX253995, KX253996, KX261851, KX261852, KX261853, KX261854, KX261855, KX262887, KX266255, KX269878, KX280026, KX358623, KX369547, KX377120, KX377335, KX377336, KX377337, KX380262, KX380263, KX421193, KX421194, KX421195, KX446950, KX446951, KX447509, KX447510, KX447511, KX447512, KX447513, KX447514, KX447515, KX447516, KX447517, KX447518, KX447519, KX447520, KX447521, KX520666, KX548902, KX576684, KX601166, KX601167, KX601168, KX601169, KX673530, KX694532, KX694533, KX694534, KX702400, KX766028, KX766029, KX806557, KX811222, KX813683, KX827309, KX830960, KX830961, KX832731, KX838904, KX838905, KX838906, KX842449, KX856011, KX867786, KX879603, KX879604, KX893855, KX922703, KX922704, KX922705, KX922706, KX922707, KX922708, KX928077, KX954122, KX986760, KX986761, KY003152, KY003153, KY003154, KY003155, KY003156, KY003157, KY007221, KY014295, KY014296, KY014297, KY014298, KY014299, KY014300, KY014301, KY014302, KY014303, KY014304, KY014305, KY014306, KY014307, KY014308, KY014309, KY014310, KY014311, KY014312, KY014313, KY014314, KY014315, KY014316, KY014317, KY014318, KY014319, KY014320, KY014321, KY014322, KY014323, KY014324, KY014325, KY014326, KY014327, KY014328, KY014329, KY075932, KY075933, KY075934, KY075935, KY075936, KY075937, KY075938, KY075939, KY120348, KY120349, KY272987, KY272991, KY288905, KY293644, KY293645, KY317936, KY317937, KY317938, KY317939, KY317940, KY325464, KY325465, KY325466, KY325467, KY325468, KY325469, KY325470, KY325471, KY325472, KY325473, KY325474, KY325475, KY325476, KY325477, KY325478, KY325479, KY325480, KY325481, KY325482, KY325483, KY328289, KY328290, KY348640, KY348860, LC002520, LC171327, LC190723, LC191864, LF621701, LG018115 or NC012532.

In particular, the term 'Zika virus protein' as used herein comprises an individual structural or non-structural Zika virus protein. For example, a Zika virus protein in the meaning of the present invention may be a protein selected from the group consisting of Zika virus capsid protein (C), Zika virus premembrane protein (prM), Zika virus pr protein, Zika virus membrane protein (M), Zika virus envelope protein (E) and a Zika virus non-structural protein (NS), such as NS1, NS2A, NS2B, NS3, NS4A, NS4B or NS5.

As used herein, the term 'Zika virus protein' may also refer to an amino acid sequence corresponding to an individual Zika virus protein as present in a Zika virus polyprotein (precursor protein). Said amino acid sequence in the polyprotein may differ from the amino acid sequence of the corresponding amino acid sequence of the respective mature Zika virus protein (i.e. after cleavage/processing the polyprotein). For example, the corresponding amino acid sequence comprised in the polyprotein may comprise amino acid residues that are removed during cleavage/processing of the polyprotein (such as a signal sequence or a target site for a protease) and that are no longer present in the respective mature Zika virus protein. In the context of the present invention, the term 'Zika virus protein' comprises both, the precursor amino acid sequence comprised in a Zika virus polyprotein (i.e. as part of a polypeptide chain optionally further comprising other viral proteins) as well as the respective mature individual Zika virus protein. For example, the term 'Zika virus capsid protein (C)' as used herein may refer to an amino acid sequence in a Zika virus polyprotein corresponding to the precursor sequence of Zika virus capsid protein (C) (comprising, for example, a (C-terminal) signal sequence) as present in a Zika virus polyprotein as well as to a mature (separate) Zika virus capsid protein (C) (no longer comprising, for example, a (C-terminal) signal sequence).

In the context of the present invention, the term 'Zika virus protein' may also refer to a Zika virus polyprotein or, more preferably to a fragment of a Zika virus polyprotein, such as a Zika virus prME or a Zika virus ME protein. In this context, the term 'Zika virus prME protein' thus refers to a protein comprising an amino acid sequence corresponding to Zika virus prME protein as comprised in a Zika virus polyprotein, or to a fragment or variant of a Zika virus prME protein as comprised in a Zika virus polyprotein. Hence, a Zika virus prME protein as used herein does not necessarily comprise full-length pr protein, full-length M protein and full-length E protein, but preferably comprises at least a fragment of each of pr, M and E protein. The same holds for the term 'ME protein' as used herein.

Also where reference is made herein to individual Zika virus proteins, such as to a 'Zika virus envelope (E) protein', said protein does not necessarily comprise the full-length amino acid sequence of said Zika virus protein, but preferably also comprises fragment or variants thereof. For example, as used herein the term 'Zika virus envelope (E) protein also comprises truncated versions of a Zika virus E proteins or Zika virus E proteins containing deletions. As used herein, the term 'Zika virus envelope (E) protein' may thus also refer to a soluble variant of Zika virus E protein (solE), such as a Zika virus E protein lacking the transmembrane domain. Furthermore, where reference is made herein to a Zika virus protein, such as to a 'Zika virus envelope (E) protein' or to a 'Zika virus prME protein', said protein may also comprise an amino acid sequence that is not derived from a Zika virus protein (e.g. a heterologous amino acid sequence).

Where reference is made to amino acid residues and their position in a Zika virus protein or in a Zika virus polyprotein, any numbering used herein—unless stated otherwise—relates to the position of the respective amino acid residue in a Zika virus polyprotein (precursor protein), wherein position '1' corresponds to the first amino acid residue, i.e. the amino acid residue at the N-terminus of a Zika virus polyprotein. More preferably, the numbering with regard to amino acid residues refers to the respective position of an amino acid residue in a Zika virus polyprotein, which is preferably derived from a Zika virus strain selected from the group consisting of ZikaSPH2015-Brazil, Z1106033-Suriname and MR766-Uganda or selected from the group consisting of ZikaSPH2015-Brazil, Z1106033-Suriname, MR766-Uganda and Natal RGN.

In some embodiments described herein, the at least one polypeptide encoded by the at least one coding region of the artificial nucleic acid may consist of an individual Zika virus protein, the amino acid sequence of which does typically not comprise an N-terminal methionin residue. It is thus understood that the phrase 'polypeptide consisting of Zika virus protein . . . ' relates to a polypeptide comprising the amino acid sequence of said Zika virus protein and—if the amino acid sequence of the respective Zika virus protein does not comprise such an N-terminal methionin residue—an N-terminal methionin residue.

In a preferred embodiment, the artificial nucleic acid comprises at least one coding region encoding at least one polypeptide comprising or consisting of at least one Zika virus protein as described herein, wherein the at least one Zika virus protein comprises an amino acid sequence according to any one of SEQ ID NO: 16, 33, 50, 536-540, 17, 34, 51, 544-555, 16, 557-635, 16, 33, 50, 639-765, 17, 34, 51, 769-808, 9641-9680 or 10968-10991, or a fragment or variant of any one of these amino acid sequences.

In the context of the present invention, it is preferred that a Zika virus protein as used herein, which comprises an amino acid sequence according to any one of SEQ ID NO: 16, 33, 50, 536-540, 17, 34, 51, 544-555, 16, 557-635, 16, 33, 50, 639-765, 17, 34, 51, 769-808, 9641-9680 or 10968-10991, or a fragment or variant of any one of these amino acid sequences, optionally comprises (in addition to the sequence as indicated in the sequence listing) an aminoterminal methionine residue, in particular in cases where an amino acid sequence as described herein does not comprise a methionine residue at the N-terminus.

According to a preferred embodiment, the inventive artificial nucleic acid comprises at least one coding region encoding at least one polypeptide comprising or consisting of at least one Zika virus protein as described herein, wherein the at least one Zika virus protein comprises an amino acid sequence according to any one of SEQ ID NO: 2 to 7, 9 to 15, 19 to 24, 26 to 32, 36 to 41 or 43 to 49, or a fragment or variant of any of these sequences.

In the context of the present invention, a 'fragment' of an amino acid sequence, such as a polypeptide or a protein, e.g. the at least one Zika virus protein as described herein, may typically comprise a sequence of a protein or peptide as defined herein, which is, with regard to its amino acid sequence (or the respective coding nucleic acid molecule), N-terminally and/or C-terminally truncated compared to the amino acid sequence of the original (native) protein (or respective coding nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide.

Preferably, a fragment of an amino acid sequence comprises or consists of a continuous stretch of amino acid residues corresponding to a continuous stretch of amino acid residues in the protein the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) protein, from which the fragment is derived.

In the context of the present invention, a fragment of a protein or of a peptide may furthermore comprise a sequence of a protein or peptide as defined herein, which has a length of for example at least 5 amino acids, preferably a length of at least 6 amino acids, preferably at least 7 amino acids, more preferably at least 8 amino acids, even more preferably at least 9 amino acids; even more preferably at least 10 amino acids; even more preferably at least 11 amino acids; even more preferably at least 12 amino acids; even more preferably at least 13 amino acids; even more preferably at least 14 amino acids; even more preferably at least 15 amino acids; even more preferably at least 16 amino acids; even more preferably at least 17 amino acids; even more preferably at least 18 amino acids; even more preferably at least 19 amino acids; even more preferably at least 20 amino acids; even more preferably at least 25 amino acids; even more preferably at least 30 amino acids; even more preferably at least 35 amino acids; even more preferably at least 50 amino acids; or most preferably at least 100 amino acids. For example such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

In this context, a fragment of a Zika virus protein encoded by the at least one coding region of the artificial nucleic acid according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of a Zika virus protein as described herein, more preferably with an amino acid sequence according to any one of SEQ ID NO: 16, 33, 50, 536-540, 17, 34, 51, 544-555, 16, 557-635, 16, 33, 50, 639-765, 17, 34, 51, 769-808, 9641-9680 or 10968-10991.

As used herein, a 'variant' of a protein or a peptide may be generated, having an amino acid sequence, which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

In the context of the present invention, a 'variant' of a protein or peptide may have at least 70%, 75%, 80%, 85%, 90%, 95%, 98% or 99% amino acid identity over a stretch of at least 10, at least 20, at least 30, at least 50, at least 75 or at least 100 amino acids of such protein or peptide. More preferably, a 'variant' of a protein or peptide as used herein is at least 40%, preferably at least 50%, more preferably at least 60%, more preferably at least 70%, even more preferably at least 80%, even more preferably at least 90%, most preferably at least 95% identical to the protein or peptide, from which the variant is derived.

As used herein, a variant of a Zika virus protein encoded by the at least one coding region of the artificial nucleic acid according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of a Zika virus protein as described herein, more preferably with an amino acid sequence according to any one of SEQ ID NO: 16, 33, 50, 536-540, 17, 34, 51, 544-555, 16, 557-635, 16, 33, 50, 639-765, 17, 34, 51, 769-808, 9641-9680 or 10968-10991.

Furthermore, variants of proteins or peptides as defined herein, which may be encoded by a nucleic acid, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence in one or more mutation(s) within the above meaning.

In a preferred embodiment, the artificial nucleic acid comprises at least one coding region comprising or consisting of at least one nucleic acid sequence according to any one of SEQ ID NO: 68, 86, 104, 812-816, 69, 87, 106, 820-831, 68, 833-911, 67, 85, 103, 915-1041, 69, 87, 105, 1045-1084, 9681-9720 or 10992-11015, or a fragment or variant of any one of these nucleic acid sequences.

In the context of the present invention, it is preferred that the at least one coding region, which comprises a nucleic acid sequence according to any one of SEQ ID NO: 68, 86, 104, 812-816, 69, 87, 106, 820-831, 68, 833-911, 67, 85, 103, 915-1041, 69, 87, 105, 1045-1084, 9681-9720 or 10992-11015, or a fragment or variant of any one of these nucleic acid sequences, optionally comprises (in addition to the sequence as indicated in the sequence listing) an ATG/AUG codon at the 5' terminus, in particular in cases where a nucleic acid sequence as described herein does not comprise an ATG/AUG codon at the 5' terminus.

According to a preferred embodiment, the at least one coding region of the inventive artificial nucleic acid comprises or consists of at least one nucleic acid sequence according to any one of SEQ ID NO: 53 to 58, 60 to 66, 70 to 76, 78 to 84, 89 to 94 or 96 to 102, or a fragment or variant of any of these sequences.

As used herein, a 'fragment' of a nucleic acid sequence comprises or consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. Such a fragment, in the sense of the present invention, is preferably a functional fragment of the full-length nucleic acid sequence.

In this context, a fragment of a nucleic acid may typically comprise a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence encoding a Zika virus protein, or a fragment or variant of such a protein, as described herein, more preferably with a nucleic acid sequence according to any one of SEQ ID NO: 68, 86, 104, 812-816, 69, 87, 106, 820-831, 68, 833-911, 67, 85, 103, 915-1041, 69, 87, 105, 1045-1084, 9681-9720 or 10992-11015.

In the context of the present invention, the phrase 'variant of a nucleic acid sequence' typically relates to a variant of a nucleic acid sequence, which forms the basis of a nucleic acid sequence. For example, a variant nucleic acid sequence may exhibit one or more nucleotide deletions, insertions, additions and/or substitutions compared to the nucleic acid sequence, from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of at least 10, at least 20, at least 30, at least 50, at least 75 or at least 100 nucleotides of such nucleic acid sequence.

Preferably, a variant of a nucleic acid as used herein comprises a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence encoding a Zika virus protein, or a fragment or variant of such a protein, as described herein, more preferably with a nucleic acid sequence according to any one of SEQ ID NO: 68, 86, 104, 812-816, 69, 87, 106, 820-831, 68, 833-911, 67, 85, 103, 915-1041, 69, 87, 105, 1045-1084, 9681-9720 or 10992-11015.

Preferably, the at least one polypeptide encoded by the at least one coding region of the inventive artificial nucleic acid comprises or consists of Zika virus envelope protein (E), or a fragment or variant thereof. More preferably, the at least one encoded polypeptide comprises or consists of an amino acid sequence according to any one of SEQ ID NO: 7, 24 or 41, or a fragment or variant of any of these sequences. In a preferred embodiment, the at least one coding region of the artificial nucleic acid sequence comprises a nucleic acid sequence according to any one of SEQ ID NO: 58, 76 or 94, or a fragment or variant of any of these sequences.

Preferably, the at least one polypeptide encoded by the at least one coding region of the inventive artificial nucleic acid comprises comprises or consists of Zika virus premembrane protein (prM) or Zika virus membrane protein (M), or a fragment or variant of any of these proteins. More preferably, the at least one encoded polypeptide comprises an amino acid sequence according to any one of SEQ ID NO: 4 to 6, 21 to 23 or 38 to 40, or a fragment or variant of any of these sequences. In a preferred embodiment, the at least one coding region of the artificial nucleic acid sequence comprises or consists of a nucleic acid sequence according to any one of SEQ ID NO: 55 to 57, 73 to 75 or 91 to 93, or a fragment or variant of any of these sequences.

In certain embodiments, the at least one polypeptide encoded by the at least one coding region of the inventive artificial nucleic acid comprises or consists of Zika virus capsid protein (C), or a fragment or variant thereof. Preferably, the at least one encoded polypeptide comprises or consists of an amino acid sequence according to any one of SEQ ID NO: 2, 19 or 36, or a fragment or variant of any of these sequences. In a preferred embodiment, the at least one coding region of the artificial nucleic acid sequence comprises or consists of a nucleic acid sequence according to any one of SEQ ID NO: 53, 71 or 89, or a fragment or variant of any of these sequences. More preferably, the at least one encoded polypeptide comprises or consists of an amino acid sequence according to any one of SEQ ID NO: 3, 20 or 37, or a fragment or variant of any of these sequences. In a preferred embodiment, the at least one coding region of the artificial nucleic acid sequence comprises or consists of a nucleic acid sequence according to any one of SEQ ID NO: 54, 72 or 90, or a fragment or variant of any of these sequences.

In certain embodiments, the at least one encoded polypeptide comprises or consists of a fragment of Zika virus capsid protein (C) or a variant of such a fragment. Preferably, the at least one encoded polypeptide comprises or consists of a C-terminal fragment of Zika virus capsid protein (C), or a variant of such a fragment.

Preferably, the at least one encoded polypeptide comprises or consists of a fragment, preferably a C-terminal fragment, or a variant of such a fragment, of a Zika virus capsid protein (C) as present in a Zika virus polyprotein (precursor protein) before cleavage. In the context of the present invention, the phrase 'Zika virus capsid protein (C) as present in a Zika virus polyprotein before cleavage' typically refers to a continuous amino acid sequence beginning at the N-terminus of a Zika virus polyprotein (before cleavage) and comprising the amino acid residue immediately N-terminal of the first amino acid residue of a precursor of Zika virus pr protein as present in the Zika virus polyprotein. In other words, the phrase 'Zika virus capsid protein (C) as present in a Zika virus polyprotein before cleavage' may refer to a part of a Zika virus polyprotein corresponding to Zika virus capsid protein (C) comprising a C-terminal fragment, preferably a C-terminal signal sequence, which is typically not present in mature Zika virus protein (C). For example, a 'Zika virus capsid protein (C) as present in a Zika virus polyprotein before cleavage' as used herein may comprise an amino acid sequence derived from an amino acid sequence corresponding to amino acid residues 1 to 122 of a Zika virus polyprotein before cleavage. According to a preferred embodiment, a Zika virus capsid protein (C) as present in a Zika virus polyprotein before cleavage comprises an amino acid sequence according to any one of SEQ ID NO: 3, 20 or 37, or a fragment or variant of any of these sequences.

Hence, a 'C-terminal fragment, or a variant of such a fragment, of Zika virus capsid protein (C) as present in a Zika virus polyprotein (precursor protein) before cleavage' preferably comprises an amino acid sequence corresponding to a continuous amino acid sequence, which is located immediately N-terminal of Zika virus pr protein in a Zika virus polyprotein before cleavage, or to a fragment or variant of said amino acid sequence. Preferably, the C-terminal fragment, or a variant of such a fragment, of Zika virus capsid protein (C) as present in a Zika virus polyprotein (precursor protein) before cleavage comprises or consists of at least 3, 4, 5, 6, 7, 8, 9, or, most preferably, at least 10 amino acid residues. Alternatively, the C-terminal fragment, or a variant of such a fragment, of Zika virus capsid protein (C) as present in a Zika virus polyprotein (precursor protein) before cleavage may consist of 3 to 40, 3 to 30, 3 to 20, 5 to 20 or 10 to 20 amino acid residues.

Preferably, the at least one polypeptide encoded by the at least one coding region of the inventive artificial nucleic acid comprises or consists of an amino acid sequence corresponding to a C-terminal fragment, or a variant of such a fragment, of Zika virus capsid protein (C) as present in a Zika virus polyprotein (precursor protein) before cleavage, wherein said amino acid sequence is preferably derived from an amino acid sequence comprising or consisting of amino acid residues 105 to 122 of a Zika virus polyprotein, or a fragment or variant thereof.

More preferably, the at least one polypeptide encoded by the at least one coding region of the inventive artificial nucleic acid comprises or consists of an amino acid sequence corresponding to a C-terminal fragment, or a variant of such a fragment, of Zika virus capsid protein (C) as present in a Zika virus polyprotein (precursor protein) before cleavage, wherein said amino acid sequence preferably comprises or consists of an amino acid sequence according to any one of SEQ ID NO: 343 to 345, or a fragment or variant of any of these sequences. Preferably, the at least one coding region of the artificial nucleic acid sequence comprises or consists of a nucleic acid sequence according to any one of SEQ ID NO: 346 to 348, or a fragment or variant of any of these sequences.

According to a preferred embodiment, the at least one polypeptide encoded by the at least one coding region of the inventive artificial nucleic acid comprises or consists of at least one amino acid sequence derived from a signal sequence, or a fragment or variant thereof.

As used herein, the term 'signal sequence' preferably refers to an amino acid sequence, which is involved in the targeting of a protein, e.g. a Zika virus protein, to a cellular compartment, preferably a membrane, more preferably a membrane of the endoplasmic reticulum (ER). A signal sequence in the context of the present invention preferably comprises from 3 to 40, 3 to 30, 3 to 20, 5 to 20 or 10 to 20 amino acid residues. Such a signal sequence may be present, for example, in a Zika virus polyprotein and may be removed during processing of said polyprotein. A signal sequence is preferably no longer present in a mature Zika virus protein. For example, Zika virus capsid protein (C) as present in a Zika virus polyprotein typically comprises a C-terminal signal sequence, corresponding to the amino acid sequence immediately N-terminal of Zika virus pr protein (e.g. amino acid residues 105 to 122 in a Zika virus polyprotein before cleavage). That signal sequence is involved in targeting Zika virus capsid protein (C) to the ER membrane and is typically removed in order to yield mature Zika virus capsid protein (C), which no longer comprises said C-terminal fragment comprising a signal sequence (see, for example, SEQ ID NO: 2, 19 or 36).

Preferably, the amino acid sequence derived from a signal sequence, or a fragment or variant thereof, comprises at least 3, 4, 5, 6, 7, 8, 9, 10, 11, 12, 13, 14, 15, 16, 17, 18, 19 or at least 20 amino acid residues. Alternatively, the amino acid sequence derived from a signal sequence, or a fragment or variant thereof may consist of 3 to 40, 3 to 30, 3 to 20, 5 to 20 or 10 to 20 amino acid residues. Most preferably, the amino acid sequence derived from a signal sequence, or a fragment or variant thereof consists of from 3 to 20 amino acid residues.

In a preferred embodiment, the at least one polypeptide encoded by the at least one coding region of the inventive artificial nucleic acid comprises or consists of at least one amino acid sequence derived from a signal sequence, which comprises or consists of an amino acid sequence that is bound by signal recognition particle (SRP). More preferably, the at least one amino acid sequence derived from a signal sequence comprises or consists of an amino acid sequence that is recognized by signal peptide peptidase (SPP), by a viral protease and/or by furin or a furin-like protease. Most preferably, the at least one amino acid sequence derived from a signal sequence comprises an amino acid sequence that is recognized by a viral protease comprising Zika virus non-structural protein 3 (NS3) and, optionally, Zika virus non-structural protein 2B (NS2B).

In a preferred embodiment, the at least one polypeptide encoded by the at least one coding region of the inventive artificial nucleic acid comprises or consists of at least one amino acid sequence derived from a signal sequence of a secretory protein or from a signal sequence of a membrane protein. More preferably, the at least one amino acid sequence derived from a signal sequence, preferably derived from a signal sequence of a membrane protein, targets the at least one encoded protein to a cellular compartment, preferably to the endoplasmic reticulum (ER), more preferably to the ER membrane.

It is further preferred that the at least one polypeptide encoded by the at least one coding region of the inventive artificial nucleic acid comprises or consists of an amino acid sequence corresponding to a signal sequence from a Zika virus protein, preferably from Zika virus capsid protein (C), more preferably from Zika virus capsid protein (C) as present in a Zika virus polyprotein before cleavage, or a fragment or variant of any of these.

According to a preferred embodiment, the at least one polypeptide encoded by the at least one coding region of the inventive artificial nucleic acid comprises or consists of an amino acid sequence corresponding to a signal sequence from Zika virus capsid protein (C) as present in a Zika virus polyprotein before cleavage, or a fragment or variant thereof, wherein the signal sequence is preferably derived from a C-terminal fragment of Zika virus capsid protein (C) as present in a Zika virus polyprotein before cleavage, preferably as described herein.

Preferably, the at least one polypeptide encoded by the at least one coding region of the inventive artificial nucleic acid comprises or consists of an amino acid sequence derived from a signal sequence of Zika virus capsid protein (C) as present in a Zika virus polyprotein (precursor protein) before cleavage, or a fragment or variant thereof. More preferably, the at least one encoded polypeptide comprises an amino acid sequence derived from an amino acid sequence comprising or consisting of amino acid residues 105 to 122, of a Zika virus polyprotein, or a fragment or variant thereof.

More preferably, the at least one polypeptide encoded by the at least one coding region of the inventive artificial nucleic acid comprises or consists at least one amino acid sequence derived from a signal sequence, which comprises or consist of an amino acid sequence according to any one of SEQ ID NO: 343 to 345, or a fragment or variant of any of these sequences. Preferably, the at least one coding region of the artificial nucleic acid sequence comprises or consists of a nucleic acid sequence according to any one of SEQ ID NO: 346 to 348, or a fragment or variant of any of these sequences.

Even more preferably, the at least one polypeptide encoded by the at least one coding region of the inventive artificial nucleic acid comprises or consists at least one amino acid sequence derived from a signal sequence, which comprises or consist of an amino acid sequence according to any one of SEQ ID NO: 343 to 345, 10961 to 10964, 10966 or 10967, or a fragment or variant of any of these sequences. Preferably, the at least one coding region of the artificial nucleic acid sequence comprises or consists of a nucleic acid sequence encoding said amino acid sequences or a fragment or variant thereof, more preferably a nucleic acid according to any one of SEQ ID NO: 346 to 348, or a fragment or variant of any of these sequences.

According to another preferred embodiment, the at least one polypeptide encoded by the at least one coding region of the inventive artificial nucleic acid comprises or consists of a fragment, preferably a C-terminal fragment, or a variant of such a fragment, of a mature Zika virus protein, preferably of a mature Zika virus capsid protein (C). In this context, it is preferred that the mature Zika virus protein is a mature Zika virus protein as defined herein.

According to a preferred embodiment, the at least one polypeptide encoded by the at least one coding region of the inventive artificial nucleic acid comprises or consists of a fragment, preferably a C-terminal fragment, or a variant of such a fragment, of mature Zika virus capsid protein (C), wherein the mature Zika virus capsid protein (C) does preferably not comprise a C-terminal signal sequence as described herein with respect to a Zika virus capsid protein (C) as present in a Zika virus polyprotein (before cleavage). More preferably, the mature Zika virus capsid protein (C) comprises or consists of an amino acid sequence according to any one of SEQ ID NO: 2, 19 or 36, or a fragment or variant thereof.

Preferably, the at least one polypeptide encoded by the at least one coding region of the inventive artificial nucleic acid comprises or consists of a C-terminal fragment, preferably as defined herein, or a variant of such a fragment, of mature Zika virus capsid protein (C).

Preferably, the C-terminal fragment, or a variant of such a fragment, of mature Zika virus capsid protein (C) comprises or consists of at least 3, 4, 5, 6, 7, 8, 9, or, most preferably, at least 10 amino acid residues. Alternatively, the C-terminal fragment, or a variant of such a fragment, of mature Zika virus capsid protein (C) may comprise or consist of 3 to 40, 3 to 30, 3 to 20, 3 to 10, 5 to 20 or 10 to 20 amino acid residues.

More preferably, the at least one polypeptide encoded by the at least one coding region of the inventive artificial nucleic acid comprises or consists of at least one amino acid sequence derived from an amino acid sequence consisting of amino acids 93 to 104, of a Zika virus polyprotein, or a fragment or variant thereof. More preferably, the at least one polypeptide encoded by the at least one coding region of the inventive artificial nucleic acid comprises or consists of at least one amino acid sequence derived from an amino acid sequence according to any one of SEQ ID NO: 361 to 363, or a fragment or variant of any of these sequences. Preferably, the at least one coding region of the artificial nucleic acid sequence comprises at least one nucleic acid sequence derived from a nucleic acid sequence according to any one of SEQ ID NO: 364 to 366, or a fragment or variant of any of these sequences.

According to another embodiment, the at least one polypeptide encoded by the at least one coding region of the inventive artificial nucleic acid comprises or consists of an amino acid sequence derived from a a) a C-terminal fragment, or a variant of such a fragment, of a mature Zika virus capsid protein (C), preferably as defined herein and b) a C-terminal fragment, or a variant of such a fragment, of Zika virus capsid protein (C) as present in a Zika virus polyprotein (precursor protein) before cleavage, preferably as defined herein; or a signal sequence, or a fragment or variant thereof, preferably as defined herein.

Therein, the amino acid sequence according to a) may be in continuation with the amino acid sequence according to b), wherein the sequences may be positioned relative to each other in any manner. Alternatively, the amino acid sequences according to a) and b) may be separated in the at least one encoded protein by another amino acid sequence. Most preferably, the amino acid sequence according to a) is located N-terminally with respect to b).

According to a preferred embodiment, the at least one polypeptide encoded by the at least one coding region of the inventive artificial nucleic acid comprises or consists of at least one amino acid sequence derived from an amino acid sequence according to any one of SEQ ID NO: 499 to 501, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 502 to 504, or a fragment or variant of any of these sequences.

Preferably, the at least one polypeptide encoded by the at least one coding region of the inventive artificial nucleic acid comprises or consists a fragment of Zika virus capsid protein (C), or a variant of said fragment, wherein the fragment or variant thereof is preferably as described above. More preferably, the at least one polypeptide encoded by the at least one coding region of the inventive artificial nucleic acid does not comprise an amino acid sequence derived from another amino acid sequence of Zika virus capsid protein (C) (distinct from the fragments described above). Most preferably, the at least one encoded polypeptide does not comprise an amino acid sequence that is derived from an amino acid sequence corresponding to amino acid residues 1 to 92, of a Zika virus polyprotein. In a preferred embodiment, the at least one encoded polypeptide does not comprise an amino acid sequence according to any of SEQ ID NO: 519, 521 or 523, or a fragment or variant thereof. Preferably, the inventive artificial nucleic acid, more preferably the at least one coding region of the inventive artificial nucleic acid, does not comprise a nucleic acid sequence according to any of SEQ ID NO: 525, 527 or 529, or a fragment or variant thereof.

In another embodiment, the at least one polypeptide encoded by the at least one coding region of the inventive artificial nucleic acid comprises or consists of a Zika virus non-structural protein, which is preferably selected from the group of NS1, NS2A, NS2B, NS3, NS4A, NS4B and NS5, or a fragment or variant of any of these proteins. Preferably, the at least one polypeptide encoded by the at least one coding region of the inventive artificial nucleic acid comprises or consists of at least one amino acid sequence derived from an amino acid sequence according to any one of SEQ ID NO: 9 to 15, 26 to 32 or 43 to 49, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 60 to 66, 78 to 84 or 96 to 102, or a fragment or variant of any of these sequences.

According to a preferred embodiment, the at least one polypeptide encoded by the at least one coding region of the inventive artificial nucleic acid comprises or consists of at least one amino acid sequence corresponding to a fragment of Zika virus non-structural protein 1 (NS1), or a variant of such a fragment.

As used herein, the term 'fragment of Zika virus non-structural protein 1 (NS1)' preferably relates to a continuous amino acid sequence derived from Zika virus non-structural protein 1 (NS1), or to a fragment or variant of said continuous amino acid sequence.

Preferably, the fragment, or variant thereof, of Zika virus non-structural protein 1 (NS1) comprises or consists of at least 3, 4, 5, 6, 7, 8, 9, or, most preferably, at least 10 amino acid residues. Alternatively, the fragment, or variant thereof, of Zika virus non-structural protein 1 (NS1) may comprise or consist of 3 to 40, 3 to 30, 3 to 20, 3 to 10, 5 to 20 or 10 to 20 amino acid residues. Most preferably, the fragment, or variant thereof, of Zika virus non-structural protein 1 (NS1) comprises or consists of from 3 to 20 amino acid residues.

In a preferred embodiment, the at least one polypeptide encoded by the at least one coding region of the inventive artificial nucleic acid comprises or consists of at least one amino acid sequence corresponding to an N-terminal fragment of Zika virus non-structural protein 1 (NS1), or a variant of said fragment.

In the context of the present invention, the term 'N-terminal fragment of Zika virus non-structural protein 1 (NS1)' relates to a continuous amino acid sequence derived from the N-terminus of Zika virus non-structural protein 1 (NS1). More preferably, the N-terminal fragment of Zika virus non-structural protein 1 (NS1) comprises or consists of from 3 to 20 amino acid residues. In a preferred embodiment, the at least one encoded polypeptide comprises an N-terminal fragment of Zika virus non-structural protein 1 (NS1), wherein the N-terminal fragment of Zika virus non-structural protein 1 (NS1) is a continuous amino acid sequence comprising or consisting of 3 to 20 amino acid residues corresponding to a continuous amino acid sequence of 3 to 20 amino acid residues in the first 20 amino acid residues (counting from the N-terminus) of Zika virus non-structural protein 1 (NS1), or a variant thereof.

In one embodiment, the at least one encoded polypeptide comprises or consists of an N-terminal fragment of Zika virus non-structural protein 1 (NS1), wherein the N-terminal fragment of Zika virus non-structural protein 1 (NS1) is a continuous amino acid sequence comprising or consisting of 3 to 20 amino acid residues corresponding to a continuous amino acid sequence of 3 to 20 amino acid residues in the first 20 amino acid residues (counting from the N-terminus) of a mature Zika virus non-structural protein 1 (NS1), or a variant thereof. Therein, the first 20 amino acid residues of a mature Zika virus non-structural protein 1 (NS1) preferably comprise or consist of the N-terminus itself (i.e. the amino acid residue at the N-terminus) and the 19 following amino acid residues.

Alternatively, the at least one encoded polypeptide comprises or consists of an N-terminal fragment of Zika virus non-structural protein 1 (NS1), wherein the N-terminal fragment of Zika virus non-structural protein 1 (NS1) is a continuous amino acid sequence consisting of 3 to 20 amino acid residues corresponding to a continuous amino acid sequence of 3 to 20 amino acid residues in the first 20 amino acid residues of Zika virus non-structural protein 1 (NS1) as present in a Zika virus polyprotein (precursor protein), or a variant thereof. The first 20 amino acid residues of Zika virus non-structural protein 1 (NS1) as present in a Zika virus polyprotein preferably correspond to the 20 amino acid residues immediately following (from N-terminus to C-terminus) the last (most C-terminal) amino acid residue of an amino acid sequence corresponding to a Zika virus protein (such as Zika virus envelope protein (E)) preceding Zika virus non-structural protein 1 (NS1) in a Zika virus polyprotein. More preferably, the at least one polypeptide encoded by the at least one coding region of the inventive nucleic acid comprises or consists of at least one amino acid sequence derived from an amino acid sequence derived from an amino acid sequence consisting of amino acid residues 795 to 804 or 791 to 800 of a Zika virus polyprotein, or a fragment or variant thereof. According to one embodiment, the at least one encoded polypeptide comprises or consists of an amino acid sequence corresponding to amino acid residues 795 to 804, or a fragment or variant thereof, of a Zika virus polyprotein derived from Zika virus strain ZikaSPH2015-Brazil, Z1106033-Suriname or Natal RGN. Alternatively, the at least one encoded polypeptide comprises or consists of an amino acid sequence corresponding to amino acid residues 791 to 800, or a fragment or variant thereof, of a Zika virus polyprotein derived from Zika virus strain MR766-Uganda.

According to a preferred embodiment, the at least one polypeptide encoded by the at least one coding region of the inventive artificial nucleic acid comprises or consists of at least one amino acid sequence derived from an amino acid sequence according to any one of SEQ ID NO:379 to 381, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 382 to 384, or a fragment or variant of any of these sequences.

Preferably, the at least one polypeptide encoded by the at least one coding region of the inventive artificial nucleic acid comprises or consists of a fragment, preferably an N-terminal fragment, of Zika virus non-structural protein 1 (NS1), or a variant of said fragment, wherein the fragment or variant thereof is preferably as described above. More preferably, the at least one polypeptide encoded by the at least one coding region of the inventive artificial nucleic acid does not comprise an amino acid sequence derived from another amino acid sequence of Zika virus non-structural protein 1 (NS1) (distinct from the fragment described above). Even more preferably, the at least one encoded polypeptide does not comprise an amino acid sequence that is derived from an amino acid sequence corresponding to amino acid residues 805 to 1146 or 801 to 1142. In a preferred embodiment, the at least one encoded polypeptide does not comprise an amino acid sequence according to any of SEQ ID NO: 520, 522 or 524, or a fragment or variant thereof. Preferably, the inventive artificial nucleic acid, more preferably the at least one coding region of the inventive artificial nucleic acid, does not comprise a nucleic acid sequence according to any of SEQ ID NO: 526, 528 or 530, or a fragment or variant thereof.

According to a preferred embodiment, the at least one polypeptide encoded by the at least one coding region of the inventive artificial nucleic acid comprises or consists of at least one amino acid sequence derived from an amino acid sequence according to any one of SEQ ID NO: 16, 33, 50, 491, 493 or 495, more preferably any one of SEQ ID NO: 16, 33, 50, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 67, 68, 85, 86, 103 or 104, or a fragment or variant of any of these sequences.

In a preferred embodiment, the at least one polypeptide encoded by the at least one coding region of the inventive artificial nucleic acid comprises a first Zika virus protein, which is preferably a Zika virus protein as described herein, or a fragment or variant thereof, and further comprises at least one second or further Zika virus protein, or a fragment or variant thereof, wherein the at least one second or further Zika virus protein, or the fragment or variant thereof, is distinct from the first Zika virus protein, or the fragment or variant thereof.

In that embodiment, the first Zika virus protein is preferably selected from the group consisting of Zika virus protein premembrane protein (prM), Zika virus pr protein, Zika virus membrane protein (M) and Zika virus envelope protein (E), or a fragment or variant thereof. Preferably, the second or further Zika virus protein is selected from the group consisting of Zika virus capsid protein (C), Zika virus envelope protein (E) and a Zika virus non-structural protein, preferably Zika virus non-structural protein 1 (NS1), or a fragment or variant thereof.

According to a preferred embodiment, the at least one polypeptide encoded by the at least one coding region of the inventive artificial nucleic acid comprises Zika virus envelope protein (E), or a fragment or variant thereof, and further comprises at least one amino acid sequence corresponding to a fragment of a further Zika virus protein, or a variant of said fragment, wherein the further Zika virus protein is not Zika virus envelope protein (E), or the fragment or variant thereof. Preferably, the further Zika virus protein is selected from Zika virus capsid protein (C), Zika virus premembrane protein (prM), Zika virus pr protein and Zika virus membrane protein (M).

Preferably, the at least one polypeptide encoded by the at least one coding region of the inventive artificial nucleic acid comprises Zika virus envelope protein (E), or a fragment or variant thereof, and further comprises at least one amino acid sequence corresponding to a fragment of Zika virus capsid protein (C), or a variant of said fragment, and/or a fragment of Zika virus membrane protein (M), wherein the fragment of Zika virus capsid protein (C) and the fragment of Zika virus membrane protein (M) is preferably a fragment as described herein, or a variant thereof.

More preferably, the at least one polypeptide encoded by the at least one coding region of the inventive artificial nucleic acid comprises Zika virus envelope protein (E), or a fragment or variant thereof, and further comprises at least one of the following:
a) an amino acid sequence corresponding to a C-terminal fragment, or a variant thereof, of mature Zika virus capsid protein (C), preferably as described herein;
b) an amino acid sequence corresponding to a C-terminal fragment, or a variant thereof, of Zika virus capsid protein (C) as present in Zikavirus polyprotein before cleavage, preferably as described herein;
c) an amino acid sequence corresponding to an N-terminal fragment, or a variant thereof, of Zika non-structural protein 1 (NS1), preferably as described herein; and/or
d) an amino acid corresponding to a fragment of Zika virus membrane protein (M).

According to a preferred embodiment, the at least one polypeptide encoded by the at least one coding region of the inventive artificial nucleic acid comprises Zika virus envelope protein (E), or a fragment or variant thereof, and further comprises, preferably in this order from N-terminus to C-terminus, at least one of the following:
a) an amino acid sequence corresponding to a C-terminal fragment, or a variant thereof, of mature Zika virus capsid protein (C), preferably as described herein;
b) an amino acid sequence corresponding to a C-terminal fragment, or a variant thereof, of Zika virus capsid protein (C) as present in Zikavirus polyprotein before cleavage, preferably as described herein; and/or
c) an amino acid sequence corresponding to an N-terminal fragment, or a variant thereof, of Zika non-structural protein 1 (NS1), preferably as described herein.

More preferably, the at least one polypeptide encoded by the at least one coding region of the inventive artificial nucleic acid comprises, preferably in this order from N-terminus to C-terminus:
a) an amino acid sequence corresponding to a C-terminal fragment, or a variant thereof, of mature Zika virus capsid protein (C), preferably as described herein;
b) an amino acid sequence corresponding to a C-terminal fragment, or a variant thereof, of Zika virus capsid protein (C) as present in Zikavirus polyprotein before cleavage, preferably as described herein;
c) Zika virus envelope protein (E), or a fragment or variant thereof; and
d) an amino acid sequence corresponding to an N-terminal fragment, or a variant thereof, of Zika non-structural protein 1 (NS1), preferably as described herein.

Even more preferably, the at least one polypeptide encoded by the at least one coding region of the inventive artificial nucleic acid comprises, preferably in this order from N-terminus to C-terminus:
a) an amino acid sequence derived from an amino acid sequence consisting of amino acid residues 93 to 104, of Zika virus polyprotein, or a fragment or variant thereof, preferably as described herein;
b) an amino acid sequence derived from an amino acid sequence consisting of amino acid residues 105 to 122, of a Zika virus polyprotein, or a fragment or variant thereof, preferably as described herein;

c) Zika virus envelope protein (E), or a fragment or variant thereof; and
d) an amino acid sequence derived from an amino acid sequence consisting of amino acid residues 795 to 804 or of amino acid residues 791 to 800, of a Zika virus polyprotein, or a fragment or variant thereof, preferably as described herein.

More preferably, the at least one polypeptide encoded by the at least one coding region of the inventive artificial nucleic acid comprises Zika virus envelope protein (E), or a fragment or variant thereof, and further comprises, preferably in this order from N-terminus to C-terminus, at least one of the following:
a) an amino acid sequence derived from an amino acid sequence corresponding to any one of SEQ ID NO: 361 to 363, or a fragment or variant thereof;
b) an amino acid sequence derived from an amino acid sequence corresponding to any one of SEQ ID NO: 343 to 345, or a fragment or variant thereof; and
c) an amino acid sequence derived from an amino acid sequence corresponding to any one of SEQ ID NO: 379 to 381, or a fragment or variant thereof.

Preferably, the at least one coding region of the inventive artificial nucleic acid comprises a nucleic acid sequence encoding Zika virus envelope protein (E), or a fragment or variant thereof, preferably a nucleic acid sequence according to any one of SEQ ID NO: 58, 76 or 94, or a fragment or variant thereof, wherein the at least one coding region further comprises, preferably in 5' to 3' direction, at least one of the following:
a) a nucleic acid sequence according to any one of SEQ ID NO: 364 to 366, or a fragment or variant thereof;
b) a nucleic acid sequence according to any one of SEQ ID NO: 346 to 348, or a fragment or variant thereof; and
c) a nucleic acid sequence according to any one of SEQ ID NO: 382 to 384, or a fragment or variant thereof.

In a preferred embodiment, the at least one polypeptide encoded by the at least one coding region of the inventive artificial nucleic acid comprises or consists of at least one amino acid sequence derived from an amino acid sequence according to any one of SEQ ID NO: 445 to 447, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 448 to 450, or a fragment or variant of any of these sequences.

According to a further preferred embodiment, the at least one polypeptide encoded by the at least one coding region of the inventive artificial nucleic acid comprises Zika virus envelope protein (E), or a fragment or variant thereof, and further comprises at least one of Zika virus premembrane protein (prM) or Zika virus membrane protein (M), or a fragment of any of these proteins.

Preferably, the at least one polypeptide encoded by the at least one coding region of the inventive artificial nucleic acid comprises a fragment of Zika virus envelope protein (E), or a variant of said fragment, and further comprises at least one of a fragment of Zika virus premembrane protein (prM) or a fragment of Zika virus membrane protein (M), or a variant of any of these fragments.

In a particularly preferred embodiment, the at least one polypeptide encoded by the at least one coding region of the inventive artificial nucleic acid comprises or consists of an amino acid sequence corresponding to amino acid residues 273 to 723 or 273 to 719, of a Zika virus polyprotein, or a fragment or variant thereof. According to one embodiment, the at least one encoded polypeptide comprises or consists of an amino acid sequence corresponding to amino acid residues 273 to 723, or a fragment or variant thereof, of a Zika virus polyprotein derived from Zika virus strain ZikaSPH2015-Brazil, Z1106033-Suriname or Natal RGN. Alternatively, the at least one encoded polypeptide comprises or consists of an amino acid sequence corresponding to amino acid residues 273 to 719, or a fragment or variant thereof, of a Zika virus polyprotein derived from Zika virus strain MR766-Uganda.

It is further preferred, that the at least one polypeptide encoded by the at least one coding region of the inventive artificial nucleic acid comprises or consists of an amino acid sequence corresponding to any one of SEQ ID NO: 17, 34 or 51, or a fragment or variant of any of these sequences. More preferably, the at least one coding region of the artificial nucleic acid sequence comprises or consists of at least one nucleic acid sequence derived from a nucleic acid sequence according to any one of SEQ ID NO: 69, 87 or 105, or a fragment or variant of any of these sequences.

In a further embodiment, the at least one polypeptide encoded by the at least one coding region of the inventive artificial nucleic acid comprises or consists of, preferably in this order from N-terminus to C-terminus,
Zika virus premembrane protein (prM) or Zika virus membrane protein (M); and
Zika virus envelope protein (E);
or a fragment or variant of any of these proteins.

According to a particularly preferred embodiment, the at least one polypeptide encoded by the at least one coding region of the inventive artificial nucleic acid comprises or consists of a continuous amino acid sequence corresponding to Zika virus premembrane protein (prM) and Zika virus envelope protein (E), or a fragment or variant of any of these proteins. Said continuous amino acid sequence is referred to herein as 'Zika virus protein prME' or 'prME'. In the context of the present invention, the term 'Zika virus protein prME' or 'prME' typically refers to a polypeptide chain comprising or consisting of an amino acid sequence corresponding to Zika virus premembrane protein (prM) and Zika virus envelope protein (E), or a fragment or variant of any of these proteins. More preferably, the term 'Zika virus protein prME' or 'prME' refers to a continuous amino acid sequence corresponding to Zika virus premembrane protein (prM) and Zika virus envelope protein (E) as present in a Zika virus polyprotein (precursor protein) prior to cleavage. Even more preferably, the at least one polypeptide encoded by the at least one coding region of the inventive artificial nucleic acid comprises or consists of Zika virus protein prME, wherein the Zika virus protein prME comprises or consists of an amino acid sequence corresponding to amino acid residues 123 to 790 or 123 to 794 of a Zika virus polyprotein, or a fragment or variant thereof. According to one embodiment, Zika virus protein prME comprises or consists of an amino acid sequence corresponding to amino acid residues 123 to 794, or a fragment or variant thereof, of a Zika virus polyprotein derived from Zika virus strain ZikaSPH2015-Brazil, Z1106033-Suriname or Natal RGN. Alternatively, Zika virus protein prME comprises or consists of an amino acid sequence corresponding to amino acid residues 123 to 790, or a fragment or variant thereof, of a Zika virus polyprotein derived from Zika virus strain MR766-Uganda.

More preferably, the at least one polypeptide encoded by the at least one coding region of the inventive artificial nucleic acid comprises or consists of an amino acid sequence derived from an amino acid sequence according to any one of SEQ ID NO: 8, 25 or 42, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 59, 77 or 95, or a fragment or variant of any of these sequences.

In a further embodiment, the at least one polypeptide encoded by the at least one coding region of the inventive artificial nucleic acid comprises or consists of, preferably in this order from N-terminus to C-terminus, Zika virus capsid protein (C), or a fragment or variant thereof, and Zika virus protein prME, preferably as described herein, or a fragment or variant thereof.

In a particularly preferred embodiment, the at least one polypeptide encoded by the at least one coding region of the inventive artificial nucleic acid comprises or consists of an amino acid sequence corresponding to 1 to 794 or 1 to 790, of a Zika virus polyprotein, or a fragment or variant thereof. According to one embodiment, the at least one encoded polypeptide comprises or consists of an amino acid sequence corresponding to amino acid residues 1 to 794, or a fragment or variant thereof, of a Zika virus polyprotein derived from Zika virus strain Brasil-SPH2015, Suriname-Z1106033 or Natal RGN. Alternatively, the at least one encoded polypeptide comprises or consists of an amino acid sequence corresponding to amino acid residues 1 to 790, or a fragment or variant thereof, of a Zika virus polyprotein derived from Zika virus strain Uganda-MR766.

More preferably, the at least one polypeptide encoded by the at least one coding region of the inventive artificial nucleic acid comprises or consists of an amino acid sequence derived from an amino acid sequence according to any one of SEQ ID NO: 397 to 399, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 400 to 402, or a fragment or variant of any of these sequences.

Alternatively, the at least one polypeptide encoded by the at least one coding region of the inventive artificial nucleic acid comprises or consists of, preferably in this order from N-terminus to C-terminus, an amino acid sequence corresponding to a C-terminal fragment, or a variant thereof, of Zika virus capsid protein (C) as present in Zikavirus polyprotein before cleavage, preferably as described herein, and Zika virus protein prME, preferably as described herein, or a fragment or variant thereof.

In a particularly preferred embodiment, the at least one polypeptide encoded by the at least one coding region of the inventive artificial nucleic acid comprises or consists of an amino acid sequence corresponding to amino acid residues 105 to 794 or 105 to 790, of a Zika virus polyprotein, or a fragment or variant thereof. According to one embodiment, the at least one encoded polypeptide comprises or consists of an amino acid sequence corresponding to amino acid residues 105 to 794, or a fragment or variant thereof, of a Zika virus polyprotein derived from Zika virus strain ZikaSPH2015-Brazil, Z1106033-Suriname or Natal RGN. Alternatively, the at least one encoded polypeptide comprises or consists of an amino acid sequence corresponding to amino acid residues 105 to 790, or a fragment or variant thereof, of a Zika virus polyprotein derived from Zika virus strain MR766-Uganda.

More preferably, the at least one polypeptide encoded by the at least one coding region of the inventive artificial nucleic acid comprises or consists of an amino acid sequence derived from an amino acid sequence according to any one of SEQ ID NO: 421 to 423, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 424 to 426, or a fragment or variant of any of these sequences.

In a further embodiment, the at least one polypeptide encoded by the at least one coding region of the inventive artificial nucleic acid comprises or consists of, preferably in this order from N-terminus to C-terminus, Zika virus capsid protein (C), or a fragment or variant thereof, Zika virus protein prME, preferably as described herein, or a fragment or variant thereof, and Zika virus non-structural protein 1 (NS1), or a fragment or variant thereof.

In a particularly preferred embodiment, the at least one polypeptide encoded by the at least one coding region of the inventive artificial nucleic acid comprises or consists of an amino acid sequence corresponding to amino acid residues 1 to 1146 or 1 to 1142, of a Zika virus polyprotein, or a fragment or variant thereof. According to one embodiment, the at least one encoded polypeptide comprises or consists of an amino acid sequence corresponding to amino acid residues 1 to 1146, or a fragment or variant thereof, of a Zika virus polyprotein derived from Zika virus strain ZikaSPH2015-Brazil, Z1106033-Suriname or Natal RGN. Alternatively, the at least one encoded polypeptide comprises or consists of an amino acid sequence corresponding to amino acid residues 1 to 1142, or a fragment or variant thereof, of a Zika virus polyprotein derived from Zika virus strain MR766-Uganda.

More preferably, the at least one polypeptide encoded by the at least one coding region of the inventive artificial nucleic acid comprises or consists of an amino acid sequence derived from an amino acid sequence according to any one of SEQ ID NO: 409 to 411, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 412 to 414, or a fragment or variant of any of these sequences.

In a further embodiment, the at least one polypeptide encoded by the at least one coding region of the inventive artificial nucleic acid comprises or consists of, preferably in this order from N-terminus to C-terminus, an amino acid sequence corresponding to a C-terminal fragment, or a variant thereof, of Zika virus capsid protein (C) as present in Zikavirus polyprotein before cleavage, preferably as described herein, Zika virus protein prME, preferably as described herein, or a fragment or variant thereof, and Zika virus non-structural protein 1 (NS1), or a fragment or variant thereof.

In a particularly preferred embodiment, the at least one polypeptide encoded by the at least one coding region of the inventive artificial nucleic acid comprises or consists of an amino acid sequence corresponding to amino acid residues 105 to 1146 or 105 to 1142, of a Zika virus polyprotein, or a fragment or variant thereof. According to one embodiment, the at least one encoded polypeptide comprises or consists of an amino acid sequence corresponding to amino acid residues 105 to 1146, or a fragment or variant thereof, of a Zika virus polyprotein derived from Zika virus strain ZikaSPH2015-Brazil, Z1106033-Suriname or Natal RGN. Alternatively, the at least one encoded polypeptide comprises or consists of an amino acid sequence corresponding to amino acid residues 105 to 1142, or a fragment or variant thereof, of a Zika virus polyprotein derived from Zika virus strain MR766-Uganda.

More preferably, the at least one polypeptide encoded by the at least one coding region of the inventive artificial nucleic acid comprises or consists of an amino acid sequence derived from an amino acid sequence according to any one of SEQ ID NO: 433 to 435, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 436 to 438, or a fragment or variant of any of these sequences.

In one embodiment of the invention, the at least one polypeptide encoded by the at least one coding region of the inventive artificial nucleic acid may comprise or consist of a Zika virus polyprotein, preferably as described herein, or a fragment or variant thereof. Preferably, the at least one polypeptide comprises or consists of a Zika virus polyprotein, or a fragment or variant thereof, wherein the polyprotein is derived from a Zika virus strain selected from the group consisting of ZikaSPH2015-Brazil, Z1106033-Suriname and MR766-Uganda or from the group consisting of ZikaSPH2015-Brazil, Z1106033-Suriname, MR766-Uganda and Natal RGN. More preferably, the at least one encoded polypeptide may comprise or consist of any one of SEQ ID NO: 1, 18 or 35, or a fragment or variant of any of these sequences. Preferably, the at least one coding region of the artificial nucleic acid sequence comprises or consists of at least one nucleic acid sequence derived from a nucleic acid sequence according to any one of SEQ ID NO: 52, 70, 88, 107, 126, 145, 176, 195 or 214, or a fragment or variant of any of these sequences.

According to a preferred embodiment, the at least one polypeptide encoded by the artificial nucleic acid according to the invention comprises or consists of an amino acid sequence according to any one of SEQ ID NO: 1 to 51, 343 to 345, 361 to 363, 379 to 381, 397 to 399, 409 to 411, 421 to 423, 433 to 435, 445 to 447, 491 to 496 or 499 to 501, or a fragment or variant of any of these sequences, preferably an amino acid sequence according to any one of SEQ ID NO: 8, 16, 17, 26, 33, 34, 43, 50, 51, 397 to 399, 409 to 411, 421 to 423, 433 to 435, 446 to 447 or 491 to 496, or a fragment or variant of any of these sequences, more preferably an amino acid sequence according to any one of SEQ ID NO: 16, 17, 33, 34, 50, 51 or 491 to 496, most preferably an amino acid sequence according to any one of SEQ ID NO: 16, 33, 50, 491, 493 or 495, or a fragment or variant thereof. More preferably, the at least one polypeptide encoded by the artificial nucleic acid according to the invention comprises or consists of an amino acid sequence, which is at least 80% identical to any one of the sequences above.

In a further preferred embodiment, the at least one coding region of the artificial nucleic acid according to the invention comprises or consists of a nucleic acid sequence according to any one of SEQ ID NO: 52 to 232, 346 to 360, 364 to 378, 382 to 396, 400 to 408, 412 to 420, 424 to 432, 436 to 444, 448 to 456 or 502 to 518, or a fragment or variant of any of these sequences, preferably a nucleic acid according to any one of SEQ ID NO: 67 to 69, 85 to 87, 103 to 105, 122 to 125, 141 to 144, 160 to 175, 191 to 194, 210 to 213, 229 to 232, 400 to 408, 412 to 420, 424 to 432, 436 to 444 or 448 to 456, or a fragment or variant of any of these sequences, more preferably a nucleic acid sequence according to any one of SEQ ID NO: 122 to 125, 141 to 144, 160 to 175, 191 to 194, 210 to 213, 229 to 232, 403 to 408, 415 to 420, 427 to 432, 439 to 444 or 451 to 456, or a fragment or variant of any of these sequences, even more preferably a nucleic acid sequence according to SEQ ID NO: 124, 125, 143, 144, 162, 163, 165, 167, 169, 171, 173 or 175, most preferably a nucleic acid sequence according to any one of SEQ ID NO: 122, 123, 141, 142, 160, 161, 164, 166, 168, 170, 172 or 174, or a fragment or variant of any of these sequences. More preferably, the at least one coding region of the artificial nucleic acid according to the invention comprises or consists of a nucleic acid sequence, which is at least 80% identical to any one of the sequences above According to a preferred embodiment, the inventive artificial nucleic acid is monocistronic, bicistronic or multicistronic.

Preferably, the inventive artificial nucleic acid is monocistronic. In that embodiment, the inventive artificial nucleic acid comprises one coding region, wherein the coding region encodes a polypeptide comprising at least two different Zika virus proteins, preferably as defined herein, or a fragment or variant thereof.

Alternatively, the inventive artificial nucleic acid can be bi- or multicistronic and comprises at least two coding regions, wherein the at least two coding regions encode at least two polypeptides, wherein each of the at least two polypeptides comprises at least one different Zika virus protein, preferably as described herein, or a fragment or variant of any one of these proteins. For example, the inventive artificial nucleic acid may comprise two coding regions, wherein the first coding region encodes a first polypeptide comprising a first Zika virus protein, or a fragment or variant thereof, and wherein the second coding region encodes a second polypeptide comprising a second Zika virus protein, or a fragment or variant thereof, wherein the first and second Zika virus proteins or a fragment or variant thereof are distinct from each other.

The inventive artificial nucleic acid may be provided as DNA or as RNA, preferably an RNA as defined herein. More preferably, the inventive artificial nucleic acid is an artificial mRNA.

The inventive artificial nucleic acid may further be single stranded or double stranded. When provided as a double stranded nucleic acid, the inventive artificial nucleic acid preferably comprises a sense and a corresponding antisense strand.

Preferably, the inventive artificial nucleic acid as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

According to one embodiment, the inventive artificial nucleic acid as defined herein, may be in the form of a modified nucleic acid, preferably a modified mRNA, wherein any modification, as defined herein, may be introduced into the inventive artificial nucleic acid. Modifications as defined herein preferably lead to a stabilized artificial nucleic acid, preferably a stabilized artificial RNA, of the present invention.

According to one embodiment, the inventive artificial nucleic acid, preferably an mRNA, may thus be provided as a "stabilized nucleic acid", preferably as a "stabilized mRNA", that is to say as a nucleic acid, preferably an mRNA, that is essentially resistant to in vivo degradation (e.g. by an exo- or endo-nuclease). Such stabilization can be effected, for example, by a modified phosphate backbone of an artificial mRNA of the present invention. A backbone modification in connection with the present invention is a modification in which phosphates of the backbone of the nucleotides contained in the mRNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized artificial nucleic acids, preferably mRNAs, may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the inventive artificial nucleic acid, preferably an mRNA, as defined herein.

Chemical Modifications:

The terms "nucleic acid modification" as used herein may refer to chemical modifications comprising backbone modifications as well as sugar modifications or base modifications.

In this context, a modified artificial nucleic acid, preferably an mRNA, as defined herein may contain nucleotide analogues/modifications, e.g. backbone modifications, sugar modifications or base modifications. A backbone modification in connection with the present invention is a modification, in which phosphates of the backbone of the nucleotides contained in an artificial nucleic acid, preferably an mRNA, as defined herein are chemically modified. A sugar modification in connection with the present invention is a chemical modification of the sugar of the nucleotides of the artificial nucleic acid, preferably an mRNA, as defined herein. Furthermore, a base modification in connection with the present invention is a chemical modification of the base moiety of the nucleotides of the artificial nucleic acid, preferably an mRNA. In this context, nucleotide analogues or modifications are preferably selected from nucleotide analogues, which are applicable for transcription and/or translation.

Sugar Modifications:

The modified nucleosides and nucleotides, which may be incorporated into a modified artificial nucleic acid, preferably an mRNA, as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (SNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diary) amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, an artificial nucleic acid, preferably an mRNA, can include nucleotides containing, for instance, arabinose as the sugar.

Backbone Modifications:

The phosphate backbone may further be modified in the modified nucleosides and nucleotides, which may be incorporated into a modified artificial nucleic acid, preferably an mRNA, as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters.

Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified nucleic acid, preferably an mRNA, as described herein can further be modified in the nucleobase moiety. Examples of nucleobases found in a nucleic acid such as RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5-triphosphate; 2-aminoadenosine-5'-triphosphate, Z-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-lodo-2'-deoxycytidine-5'-triphosphate, 5-iodouridine-5'-triphosphate, 5-lodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyluridine, 1-carboxymethyl-pseudouridine, 5-propynyluridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group.

In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified artificial nucleic acid, preferably an mRNA, may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

In some embodiment, the artificial nucleic acid according to the invention comprises at least one coding region as defined herein, wherein the coding region comprises at least one modified uridine nucleoside, more preferably N(1)-methylpseudouridine (m1ψ). Therein, the artificial nucleic acid, preferably the at least one coding region, preferably comprises at least one of the nucleic acid sequences according to any one of SEQ ID NO: 9681-9684, more preferably SEQ ID NO: 9721-9724, 9761-9764, 9801-9804, 9881-9884, 9921-9924 or 9961-9964, or a fragment or variant of any one of these nucleic acid sequences. More preferably, the at least one coding region encodes a polypeptide comprising or consisting of any one of the amino acid sequences according to SEQ ID NO: 9641-9644, or a fragment or variant of any one of these amino acid sequences.

Lipid Modification:

According to a further embodiment, a modified artificial nucleic acid, preferably an mRNA, as defined herein can contain a lipid modification. Such a lipid-modified artificial nucleic acid as defined herein typically further comprises at least one linker covalently linked with that artificial nucleic acid, and at least one lipid covalently linked with the respective linker. Alternatively, the lipid-modified artificial nucleic acid comprises at least one artificial nucleic acid as defined herein and at least one (bifunctional) lipid covalently linked (without a linker) with that artificial nucleic acid. According to a third alternative, the lipid-modified artificial nucleic acid comprises an artificial nucleic acid molecule as defined herein, at least one linker covalently linked with that artificial nucleic acid, and at least one lipid covalently linked with the respective linker, and also at least one (bifunctional) lipid covalently linked (without a linker) with that artificial nucleic acid. In this context, it is particularly preferred that the lipid modification is present at the terminal ends of a linear artificial nucleic acid.

G/C Content Modification:

According to another embodiment, the artificial nucleic acid of the present invention may be modified, and thus stabilized, by modifying the G/C content of the artificial nucleic acid, preferably an mRNA, preferably of the coding region of the inventive artificial nucleic acid.

Preferably, the G/C content of the at least one coding region of the artificial nucleic acid, preferably an mRNA, is modified, preferably increased, compared to the G/C content of the corresponding coding sequence of the wild-type nucleic acid, preferably an mRNA, wherein the encoded amino acid sequence is preferably not modified compared to the amino acid sequence encoded by the corresponding wild-type nucleic acid (i.e. the non-modified nucleic acid), preferably an mRNA. This modification of the inventive artificial nucleic acid, preferably of an mRNA, as described herein is based on the fact that the sequence of any mRNA region to be translated is important for efficient translation of that mRNA. Thus, the composition and the sequence of various nucleotides are important. In particular, sequences having an increased G (guanosine)/C (cytosine) content are more stable than sequences having an increased A (adenosine)/U (uracil) content. According to the invention, the codons of the artificial nucleic acid, preferably an mRNA, are therefore varied compared to the respective wild-type mRNA, while retaining the translated amino acid sequence, such that they include an increased amount of G/C nucleotides. In respect to the fact that several codons encode one and the same amino acid (so-called degeneration of the genetic code), the most favorable codons for the stability can be determined (so-called alternative codon usage). Depending on the amino acid to be encoded by the artificial nucleic acid, preferably an mRNA, there are various possibilities for modification of its sequence, compared to its wild-type sequence. In the case of amino acids which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present.

In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons, which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the inventive artificial nucleic acid, preferably an mRNA, compared to its corresponding wild-type sequence, such as the corresponding wild-type mRNA sequence. Thus, for example, all codons for Thr occurring in the wild-type sequence can be modified to ACC (or ACG). Preferably, however, for example, combinations of the above substitution possibilities are used:

substitution of all codons coding for Thr in the original sequence (wild-type mRNA) to ACC (or ACG) and
substitution of all codons originally coding for Ser to UCC (or UCG or AGC); substitution of all codons coding for Ile in the original sequence to AUC and
substitution of all codons originally coding for Lys to AAG and
substitution of all codons originally coding for Tyr to UAC;
substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Arg to CGC (or CGG); substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Gly to GGC (or GGG) and
substitution of all codons originally coding for Asn to AAC; substitution of all codons coding for Val in the original sequence to GUC (or GUG) and
substitution of all codons originally coding for Phe to UUC and
substitution of all codons originally coding for Cys to UGC and
substitution of all codons originally coding for Leu to CUG (or CUC) and
substitution of all codons originally coding for Gln to CAG and
substitution of all codons originally coding for Pro to CCC (or CCG); etc. Preferably, the G/C content of the coding region of the inventive artificial nucleic acid, preferably an mRNA, is increased by at least 7%, more preferably by at least 15%, particularly preferably by at least 20%, compared to the G/C content of the coding region of the wild-type nucleic acid. According to a specific embodiment at least 5%, 10%, 20%, 30%, 40%, 50%, 60%, more preferably at least 70%, even more preferably at least 80% and most preferably at least 90%, 95% or even 100% of the substitutable codons in the coding region or the whole sequence of the wild type nucleic acid sequence, preferably an mRNA sequence, are substituted, thereby increasing the G/C content of said sequence. In this context, it is particularly preferable to increase the G/C content of the inventive artificial nucleic acid to the maximum (i.e. 100% of the substitutable codons), in particular in the region coding for the at least one protein, compared to the wild-type sequence.

According to the invention, a further preferred modification of the artificial nucleic acid of the present invention is based on the finding that the translation efficiency is also determined by a different frequency in the occurrence of tRNAs in cells. It is thus preferred that the at least one coding region of the artificial nucleic acid according to the invention comprises a nucleic acid sequence, which is codon-optimized. The term 'odon-optimized' as used herein typically refers to an artificial nucleic acid, preferably to a nucleic acid sequence in the at least one coding region therein, wherein at least one codon of the wild-type sequence, which codes for a tRNA which is relatively rare in the cell, is exchanged for a codon, which codes for a tRNA which is relatively frequent in the cell and carries the same amino acid as the relatively rare tRNA. Most preferably, that modification also increases the G/C content of the at least one coding region of the artificial nucleic acid.

Thus, if so-called "rare codons" are present in the artificial nucleic acid of the present invention to an increased extent, the corresponding modified nucleic acid sequence, preferably an mRNA sequence, is translated to a significantly poorer degree than in the case where codons coding for relatively "frequent" tRNAs are present. According to the invention, in the modified artificial nucleic acid of the present invention, the region which encodes the at least one protein as defined herein is modified compared to the corresponding region of the wild-type nucleic acid, preferably an mRNA, such that at least one codon of the wild-type sequence, which codes for a tRNA which is relatively rare in the cell, is exchanged for a codon, which codes for a tRNA which is relatively frequent in the cell and carries the same amino acid as the relatively rare tRNA. By this modification, the sequences of the artificial nucleic acid of the present invention is modified such that codons for which frequently occurring tRNAs are available are inserted. In other words, according to the invention, by this modification all codons of the wild-type sequence which code for a tRNA which is relatively rare in the cell can in each case be exchanged for a codon which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified artificial nucleic acid of the present invention, with the "frequent" codons without modifying the amino acid sequence of the protein encoded by the coding region of the corresponding wild type nucleic acid, preferably an mRNA. This preferred embodiment allows provision of a particularly efficiently translated and stabilized (modified) artificial nucleic acid of the present invention. The determination of an artificial nucleic acid of the present invention as described above (increased G/C content; exchange of tRNAs) can be carried out using the computer program explained in WO 02/098443—the disclosure content of which is included in its full scope in the present invention. Using this computer program, the nucleotide sequence of any desired mRNA can be modified with the aid of the genetic code or the degenerative nature thereof such that a maximum G/C content results, in combination with the use of codons which code for tRNAs occurring as frequently as possible in the cell, the amino acid sequence encoded by the artificial nucleic acid preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the artificial nucleic acid of the present invention is increased compared to the A/U content in the environment of the ribosome binding site of its particular wild-type nucleic acid, preferably an mRNA. This modification (an increased A/U content around the ribosome binding site) increases the efficiency of ribosome binding to the artificial nucleic acid. An effective binding of the ribosomes to the ribosome binding site (e.g. a Kozak sequence as known in the art) in turn has the effect of an efficient translation of the artificial nucleic acid. According to a further embodiment of the present invention, the artificial nucleic acid of the present invention may be modified with respect to potentially destabilizing sequence elements. Particularly, the coding region and/or the 5' and/or 3' untranslated region of the artificial nucleic acid may be modified compared to the particular wild-type nucleic acid such that it contains no destabilizing sequence elements, the amino acid sequence encoded by the modified artificial nucleic acid preferably not being modified compared to its particular wild-type nucleic acid. It is known that, for example, in sequences of eukaryotic RNAs destabilizing sequence elements (DSE) occur, to which signal proteins bind and regulate enzymatic degradation of RNA in vivo. For further stabilization of the modified artificial nucleic acid, optionally in the region which encodes the at least one protein as defined herein, one or more such modifications compared to the corresponding region of the wild-type nucleic acid, preferably an mRNA, can therefore be carried out, so that no or substantially no destabilizing sequence elements are contained there. According to the invention, DSE present in the untranslated regions (3'- and/or 5'-UTR) can also be eliminated from the artificial nucleic acid of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The artificial nucleic acid of the present invention is therefore preferably modified compared to the wild-type nucleic acid such that the artificial nucleic acid contains no such destabilizing sequences. This also applies to those sequence motifs which are recognized by possible endonucleases, e.g. the sequence GAACAAG, which is contained in the 3'-UTR segment of the gene which codes for the transferrin receptor (Binder et al., EMBO J. 1994, 13: 1969 to 1980). These sequence motifs are also preferably removed in the artificial nucleic acid of the present invention. It is further preferred that the artificial nucleic acid of the present invention has, in a modified form, at least one IRES as defined above and/or at least one 5' and/or 3' stabilizing sequence, in a modified form, e.g. to enhance ribosome binding or to allow expression of different encoded polypeptides located on an artificial nucleic acid of the present invention. This particularly applies to embodiments, wherein the artificial nucleic acid is bi- or multicistronic and wherein an IRES is preferably located between individual coding regions.

According to a preferred embodiment, the at least one coding region of the artificial nucleic acid comprises or consists of at least one nucleic acid sequence according to any one of SEQ ID NO: 107 to 232, 349 to 360, 367 to 378, 385 to 396, 403 to 408, 415 to 420, 427 to 432, 439 to 444, 451 to 456 or 505 to 516, or a fragment or variant of any of these sequences. More preferably, the at least one coding region of the artificial nucleic comprises or consists of an RNA sequence, which is at least 80% identical to any one of SEQ ID NO: 107 to 232, 349 to 360, 367 to 378, 385 to 396, 403 to 408, 415 to 420, 427 to 432, 439 to 444, 451 to 456 or 505 to 516.

In a particularly preferred embodiment, the at least one coding region of the artificial nucleic acid comprises or consists of at least one nucleic acid sequence according to any one of SEQ ID NO: 122, 124, 141, 143, 160, 164, 166, 168, 170, 172 or 174, or a fragment or variant of any of these sequences. More preferably, the at least one coding region of the artificial nucleic comprises or consists of an RNA sequence, which is at least 80% identical to any one of SEQ ID NO: 122, 124, 141, 143, 160, 164, 166, 168, 170, 172 or 174.

Alternatively, the at least one coding region of the artificial nucleic acid may comprise at least one nucleic acid sequence according to any one of SEQ ID NO: 164 to 232, 352 to 360, 370 to 378, 388 to 396, 406 to 408, 418 to 420, 430 to 432, 442 to 444, 454 to 456 or 508 to 516, or a fragment or variant of any of these sequences. More preferably, the at least one coding region of the artificial nucleic comprises an RNA sequence, which is at least 80% identical to any one of SEQ ID NO: 164 to 232, 352 to 360, 370 to 378, 388 to 396, 406 to 408, 418 to 420, 430 to 432, 442 to 444, 454 to 456 or 508 to 516. In one embodiment, the at least one coding region of the artificial nucleic acid may comprise at least one nucleic acid sequence according to any one of SEQ ID NO: 164, 166, 168, 170, 172 or 174, or a fragment or variant of any of these sequences. More preferably, the at least one coding region of the artificial nucleic comprises an RNA sequence, which is at least 80% identical to any one of SEQ ID NO: 164, 166, 168, 170, 172 or 174.

In a particularly preferred embodiment, the at least one coding region of the artificial nucleic acid according to the invention comprises or consists of a nucleic acid sequence as defined by any one of the nucleic acid sequences according to SEQ ID NO: 122, 141, 160, 1088-1092, 124, 143, 162, 1096-1107, 1108, 1109-1187, 122, 141, 160, 1191-1317, 124, 143, 162, 1321-1360, 9721-9760, 11016-11039, 1361-1636, 9761-9800, 11040-11063, 1637-1912, 9801-9840, 11064-11087, 1913-2188, 9841-9880, 11088-11111, 2189-2464, 9881-9920, 11112-11135, 2465-2740, 9921-9960, 11136-11159, 2741-3016, 9961-10000 or 11160-11183, or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to SEQ ID NO: 122, 141, 160, 1088-1092, 124, 143, 162, 1096-1107, 1108, 1109-1187, 122, 141, 160, 1191-1317, 124, 143, 162, 1321-1360, 9721-9760, 11016-11039, 1361-1636, 9761-9800, 11040-11063, 1637-1912, 9801-9840, 11064-11087, 1913-2188, 9841-9880, 11088-11111, 2189-2464, 9881-9920, 11112-11135, 2465-2740, 9921-9960, 11136-11159, 2741-3016, 9961-10000 or 11160-11183, or a fragment or variant of any one of these sequences.

Modification of the 5'-end of a modified artificial nucleic acid: According to another preferred embodiment of the invention, the artificial nucleic acid, preferably an mRNA, as defined herein, can be modified by the addition of a so-called "5'-CAP" structure, which preferably stabilizes the nucleic acid, preferably an mRNA, as described herein.

In a particularly preferred embodiment, the artificial nucleic acid according to the invention, preferably an mRNA, comprises a 5'-CAP structure.

A 5'-cap is an entity, typically a modified nucleotide entity, which generally "caps" the 5'-end of a nucleic acid, for example of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-CAP structure, which naturally occurs in mRNA transcribed by polymerase II and is therefore preferably not considered as modification comprised in an artificial nucleic acid in this context. Accordingly, a modified artificial nucleic acid, preferably an mRNA, of the present invention may comprise a m7GpppN as 5'-CAP, but additionally the modified artificial nucleic acid, preferably an mRNA, typically comprises at least one further modification as defined herein.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-CAP structures are regarded as at least one modification in this context.

Particularly preferred modified 5'-CAP structures are CAP1 (methylation of the ribose of the adjacent nucleotide of m7G), CAP2 (methylation of the ribose of the 2nd nucleotide downstream of the m7G), CAP3 (methylation of the ribose of the 3rd nucleotide downstream of the m7G), CAP4 (methylation of the ribose of the 4th nucleotide downstream of the m7G), ARCA (anti-reverse CAP analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-CAP structure may be introduced into the artificial nucleic acid according to the invention by any method known in the art. According to one embodiment, a 5'-CAP structure is introduced into the artificial nucleic acid co-transcriptionally. Alternatively, a 5'-CAP structure, such as a CAP1, may be introduced by enzymatic capping of the artificial nucleic acid.

Enzymatic capping of the artificial nucleic acid, preferably an RNA, may be performed by using, for example, vaccinia virus capping enzymes. The vaccinia virus capping enzyme is a heterodimer of two polypeptides (D1-D12) executing all three steps of m7GpppRNA synthesis. In the presence of a methyl donor (S-adenosylmethionine) and GTP, enzymatic capping is facilitated with high efficiency in the naturally occurring forward orientation, resulting in the generation of a cap0 structure (m7GpppNp-RNA).

Alternatively, Cap-specific nucleoside 2'-O-methyltransferase enzyme may be used, which creates a canonical 5'-5'-triphosphate linkage between the 5'-terminal nucleotide of the artificial nucleic acid, in particular an mRNA, and a guanine cap nucleotide wherein the cap guanine contains an N7 methylation and the 5'-terminal nucleotide of the nucleic acid contains a 2'-O-methyl. Such a structure is termed the cap1 structure (m7GpppNmp-RNA).

According to one embodiment, the artificial nucleic acid is an in vitro transcribed RNA, which is enzymatically capped, preferably as described herein, after in vitro transcription.

According to a further embodiment, the artificial nucleic acid comprises an untranslated region (UTR). More preferably, the artificial nucleic acid according to the invention, preferably an mRNA, comprises at least one of the following structural elements: a 5'- and/or 3'-untranslated region element (UTR element), particularly a 5'-UTR element, which comprises or consists of a nucleic acid sequence which is derived from the 5'-UTR of a TOP gene or from a fragment, homolog or a variant thereof, or a 5'- and/or 3'-UTR element which may be derivable from a gene that provides a stable mRNA or from a homolog, fragment or variant thereof; a histone-stem-loop structure, preferably a histone-stem-loop in its 3' untranslated region; a 5'-CAP structure; a poly-A tail; or a poly(C) sequence.

According to the invention, it is preferred that the artificial nucleic acid comprises at least one coding region as defined herein and further comprises
a 5'-UTR element, preferably as described herein,
a 3'-UTR element, preferably as described herein,
a histone stem-loop, preferably as described herein,
a poly(A) sequence, preferably as described herein, and/or
a poly(C) sequence, preferably as described herein,
wherein at least one of the 5'-UTR element, the 3'-UTR element, the histone stem-loop,
the poly(A) sequence and the poly(C) sequence is heterologous with respect to the at least one coding region of the artificial nucleic acid. In this context, the term 'heterologous' refers to a nucleic acid sequence derived from another gene. The term also comprises a nucleic acid sequence derived from another organism.

More preferably, the artificial nucleic acid comprises at least one coding region as defined herein and further comprises
a 5'-UTR element, preferably as described herein,
a 3'-UTR element, preferably as described herein,
a histone stem-loop, preferably as described herein,
a poly(A) sequence, preferably as described herein, and/or
a poly(C) sequence, preferably as described herein,
wherein at least one of the 5'-UTR element, the 3'-UTR element, the histone stem-loop,
the poly(A) sequence and the poly(C) sequence is not derived from a Zika virus or from another flavivirus.

According to certain embodiments, the artificial nucleic acid comprises at least one coding region as defined herein and further comprises at least two elements selected from the group consisting of
a 5'-UTR element, preferably as described herein,
a 3'-UTR element, preferably as described herein,
a histone stem-loop, preferably as described herein,
a poly(A) sequence, preferably as described herein, and
a poly(C) sequence, preferably as described herein,
wherein the at least two elements are heterologous with respect to each other. More preferably, the at least two elements are heterologous with respect to each other and also to the at least one coding region.

In a preferred embodiment, the artificial nucleic acid, preferably an mRNA, comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably the 5'- or 3'-UTR element used according to the present invention is heterologous to the coding region of the inventive artificial nucleic acid. Even if 5'- or 3'-UTR elements derived from naturally occurring genes are preferred, also synthetically engineered UTR elements may be used in the context of the present invention.

It is preferred that the artificial nucleic acid comprises at least one 5'-UTR element or at least one 3'-UTR element, wherein the 5'-UTR element or the 3'-UTR element are heterologous with respect to the at least one coding region. More preferably, the artificial nucleic acid comprises at least one 5'-UTR element or at least one 3'-UTR element, wherein the 5'-UTR element or the 3'-UTR element is not derived from a Zika virus or from another flavivirus.

According to a preferred embodiment, the artificial nucleic acid according to the invention comprises a 5'-UTR.

More preferably, the artificial nucleic acid comprises a 5'-UTR comprising at least one heterologous 5'-UTR element.

In a particularly preferred embodiment, the artificial nucleic acid comprises at least one 5'-untranslated region element (5'UTR element), preferably a heterologous 5'-UTR element, which comprises or consists of a nucleic acid sequence, which is derived from the 5'UTR of a TOP gene or which is derived from a fragment, homolog or variant of the 5'UTR of a TOP gene.

It is particularly preferred that the 5'UTR element does not comprise a TOP-motif or a 5'TOP, as defined above.

In some embodiments, the nucleic acid sequence of the 5'UTR element, which is derived from a 5'UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'UTR element does not comprise any part of the protein coding region. Thus, preferably, the only protein coding part of the artificial nucleic acid is provided by the at least one coding region.

The nucleic acid sequence, which is derived from the 5'UTR of a TOP gene, is typically derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'UTR element is preferably selected from 5'-UTR elements comprising or consisting of a nucleic acid sequence, which is derived from a nucleic acid sequence selected from the group consisting of SEQ ID Nos. 1-1363, SEQ ID NO. 1395, SEQ ID NO. 1421 and SEQ ID NO. 1422 of the patent application WO2013/143700, whose disclosure is incorporated herein by reference, from the homologs of SEQ ID Nos. 1-1363, SEQ ID NO. 1395, SEQ ID NO. 1421 and SEQ ID NO. 1422 of the patent application WO2013/143700, from a variant thereof, or preferably from a corresponding RNA sequence. The term "homologs of SEQ ID Nos. 1-1363, SEQ ID NO. 1395, SEQ ID NO. 1421 and SEQ ID NO. 1422 of the patent application WO2013/143700" refers to sequences of other species than *Homo sapiens*, which are homologous to the sequences according to SEQ ID Nos. 1-1363, SEQ ID NO. 1395, SEQ ID NO. 1421 and SEQ ID NO. 1422 of the patent application WO2013/143700.

In a preferred embodiment, the 5'UTR element of the artificial nucleic acid, preferably an mRNA, comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID Nos. 1-1363, SEQ ID NO. 1395, SEQ ID NO. 1421 and SEQ ID NO. 1422 of the patent application WO2013/143700, from the homologs of SEQ ID Nos. 1-1363, SEQ ID NO. 1395, SEQ ID NO. 1421 and SEQ ID NO. 1422 of the patent application WO2013/143700 from a variant thereof, or a corresponding RNA sequence. It is particularly preferred that the 5' UTR element is derived from a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID Nos. 1-1363, SEQ ID NO. 1395, SEQ ID NO. 1421 and SEQ ID NO. 1422 of the patent application WO2013/143700, from the homologs of SEQ ID Nos. 1-1363, SEQ ID NO. 1395, SEQ ID NO. 1421 and SEQ ID NO. 1422 of the patent application WO2013/143700, from a variant thereof, or a corresponding RNA sequence.

In a particularly preferred embodiment, the 5'UTR element comprises or consists of a nucleic acid sequence, which is derived from a 5'UTR of a TOP gene encoding a ribosomal protein or from a variant of a 5'UTR of a TOP gene encoding a ribosomal protein. For example, the 5'UTR element comprises or consists of a nucleic acid sequence, which is derived from a 5'UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'end of the sequences) corresponds to the 5'UTR of said sequences.

Preferably, the artificial nucleic acid according to the invention comprises a 5'-UTR comprising at least one heterologous 5'-UTR sequence, wherein the at least one heterologous 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the 5'TOP motif.

Preferably, the 5'UTR element comprises or consists of a nucleic acid sequence, which is derived from a 5'UTR of a TOP gene encoding a ribosomal Large protein (RPL) or from a homolog or variant of a 5'UTR of a TOP gene encoding a ribosomal Large protein (RPL). For example, the 5'UTR element comprises or consists of a nucleic acid sequence, which is derived from a 5'UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In a particularly preferred embodiment, the 5'UTR element comprises or consists of a nucleic acid sequence, which is derived from the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'UTR element does not comprise the 5'TOP of said gene.

Accordingly, in a particularly preferred embodiment, the 5'UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 457 (5'-UTR of human ribosomal protein Large 32 lacking the 5' terminal oligopyrimidine tract; corresponding to SEQ ID No. 1368 of the patent application WO2013/143700) or preferably to a corresponding RNA sequence, such as SEQ ID NO: 458, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 457 or more preferably to a corresponding RNA sequence, such as SEQ ID NO: 458, wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the artificial nucleic acid according to the invention comprises a 5'UTR element, which comprises or consists of a nucleic acid sequence, which is derived from the 5'UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3E1P, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'UTR element does not comprise a TOP-motif or the 5'TOP of said genes, and wherein optionally the 5'UTR element starts at its 5'-end with a nucleotide located at position 1, 2, 3, 4, 5, 6, 7, 8, 9 or 10 downstream of the 5'terminal oligopyrimidine tract (TOP) and wherein further optionally the 5'UTR element which is derived from a 5'UTR of a TOP gene terminates at its 3'-end with a nucleotide located at position 1, 2, 3, 4, 5, 6, 7, 8, 9 or 10 upstream of the start codon (A(U/T)G) of the gene it is derived from.

According to a preferred embodiment, the artificial nucleic acid comprises at least one heterologous 5'-UTR element comprising a nucleic acid sequence, which is derived from a 5'-UTR of a TOP gene encoding a ribosomal Large protein (RPL), preferably RPL32 or RPL35A, or from a gene selected from the group consisting of HSD17B4, ATP5A1, AIG1, ASAH1, COX6C or ABCB7 (also referred to herein as MDR), or from a homolog, a fragment or variant of any one of these genes, preferably lacking the 5'TOP motif.

In further particularly preferred embodiments, the 5'UTR element comprises or consists of a nucleic acid sequence, which is derived from the 5'UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), a N-acylsphingosine amidohydrolase (acid ceramidase) 1 gene (ASAH1), or an ATP-Binding Cassette, Sub-Family B (MDR/TAP), Member 7 gene (ABCB7), or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), a vertebrate N-acylsphingosine amidohydrolase (acid ceramidase) 1 gene (ASAH1), or a vertebrate ATP-Binding Cassette, Sub-Family B (MDR/TAP), Member 7 gene (ABCB7), or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit Vic gene (COX6C), a mammalian N-acylsphingosine ami-dohydrolase (acid ceramidase) 1 gene (ASAH1), or a mammalian ATP-Binding Cassette, Sub-Family B (MDR/TAP), Member 7 gene (ABCB7), or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit Vic gene (COX6C), a human N-acylsphingosine amidohydrolase (acid ceramidase) 1 gene (ASAH1), or a human ATP-Binding Cassette, Sub-Family B (MDR/TAP), Member 7 gene (ABCB7), or from a variant thereof, wherein preferably the 5'UTR element does not comprise the 5'TOP of said gene.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1412-1420 of the patent application WO2013/143700, or a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1412-1420 of the patent application WO2013/143700, wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

According to a particularly preferred embodiment, the artificial nucleic acid comprises a 5'-UTR comprising at least one heterologous 5'-UTR element, wherein the heterologous 5'-UTR element comprises a nucleic acid sequence according to SEQ ID NO. 457 to 474, or a homolog, a fragment or a variant thereof. Preferably, the at least one heterologous 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence according to any one of SEQ ID NO. 457 to 474.

According to a preferred embodiment, the artificial nucleic acid according to the invention comprises a 3'-untranslated region (3'-UTR). More preferably, the artificial nucleic acid according to the invention comprises a 3'-UTR comprising or consisting of at least one heterologous 3'-UTR element, preferably as defined herein.

According to a further preferred embodiment, the artificial nucleic acid, preferably the 3'-UTR, may contain a poly-A tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the artificial nucleic acid, preferably an mRNA, is derived from a DNA template by in vitro transcription. Alternatively, the poly(A) sequence may also be obtained in vitro by common methods of chemical-synthesis without being necessarily transcribed from a DNA progenitor.

Alternatively, the artificial nucleic acid, preferably an mRNA, optionally comprises a polyadenylation signal, which is defined herein as a signal, which conveys polyadenylation to a (transcribed) mRNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

According to a further preferred embodiment, the artificial nucleic acid of the present invention, preferably the 3'-UTR of the artificial nucleic acid, may contain a poly-C tail of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In a further preferred embodiment, the artificial nucleic acid according to the invention further comprises at least one 3'UTR element, which comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene.

The term '3'UTR element' refers to a nucleic acid sequence, which comprises or consists of a nucleic acid sequence that is derived from a 3'UTR or from a variant of a 3'UTR. A 3'UTR element in the sense of the present invention may represent the 3'UTR on a DNA or on an RNA level. Thus, in the sense of the present invention, preferably, a 3'UTR element may be the 3'UTR of an mRNA, preferably of an artificial mRNA, or it may be the transcription template for a 3'UTR of an mRNA. Thus, a 3'UTR element preferably is a nucleic acid sequence, which corresponds to the 3'UTR of an mRNA, preferably to the 3'UTR of an artificial mRNA, such as an mRNA obtained by transcription of a genetically engineered vector construct. Preferably, the 3'UTR element fulfils the function of a 3'UTR or encodes a sequence, which fulfils the function of a 3'UTR.

Preferably, the artificial nucleic acid comprises a 3'UTR element comprising or consisting of a nucleic acid sequence derived from a 3'-UTR of a gene, which preferably encodes a stable mRNA, or from a homolog, a fragment or a variant of said gene. In particular, the 3'-UTR element may be derivable from a gene that relates to an mRNA with an enhanced half-life (that provides a stable mRNA), for example a 3'UTR element as defined and described below. In a particularly preferred embodiment, the 3'UTR element comprises or consists of a nucleic acid sequence which is derived from a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene. More preferably, the 3'UTR element comprises or consists of a nucleic acid sequence which is derived from a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID No. 1369-1390 of the patent application WO2013/143700, whose disclosure is incorporated herein by reference, or from a homolog, a fragment or a variant thereof.

In a particularly preferred embodiment, the 3'UTR element comprises or consists of a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a fragment or variant thereof. More preferably, the 3'-UTR element comprises or consists of a nucleic acid according to SEQ ID No. 475 or 476 (corresponding to SEQ ID No: 1369 of the patent application WO2013/143700), or a fragment, homolog or variant thereof.

Most preferably the 3'-UTR element comprises or consists of the nucleic acid sequence derived from a fragment of the human albumin gene according to SEQ ID No. 485 or 486 (corresponding to SEQ ID No: 1376 of the patent application WO2013/143700), or a fragment, homolog or variant thereof.

In another particularly preferred embodiment, the at least one heterologous 3'-UTR element comprises or consists of a nucleic acid sequence derived from a 3'UTR of an α-globin gene, preferably a vertebrate α- or β-globin gene, more preferably a mammalian α- or β-globin gene, most preferably a human α- or β-globin gene.

More preferably, the 3'-UTR element comprises or consists of a nucleic acid according to SEQ ID No. 477 or 478 (corresponding to SEQ ID No. 1370 of the patent application WO2013/143700), or a homolog, a fragment, or a variant thereof.

Preferably, the at least one heterologous 3'-UTR element comprises or consists of a nucleic acid sequence derived from a 3'UTR of *Homo sapiens* hemoglobin, alpha 1 (HBA1). More preferably, the 3'-UTR element comprises or consists of a nucleic acid according to SEQ ID No. 477 or 478 (corresponding to SEQ ID No. 1370 of the patent application WO2013/143700), or a homolog, a fragment, or a variant thereof.

In another embodiment, the at least one heterologous 3'-UTR element comprises or consists of a nucleic acid sequence derived from a 3'UTR of *Homo sapiens* hemoglobin, alpha 2 (HBA2). More preferably, the 3'-UTR element comprises or consists of a nucleic acid according to SEQ ID No. 479 or 480 (corresponding to SEQ ID No. 1371 of the patent application WO2013/143700), or a homolog, a fragment, or a variant thereof.

According to another embodiment, the at least one heterologous 3'-UTR element comprises or consists of a nucleic acid sequence derived from a 3'UTR of *Homo sapiens* hemoglobin, beta (HBB). More preferably, the 3'-UTR element comprises or consists of a nucleic acid according to SEQ ID No. 481 or 482 (corresponding to SEQ ID No. 1372 of the patent application WO2013/143700), or a homolog, a fragment, or a variant thereof.

The at least one heterologous 3'-UTR element may further comprise or consist of the center, α-complex-binding portion of the 3'UTR of an α-globin gene, such as of a human α-globin gene, or a homolog, a fragment, or a variant of an α-globin gene, preferably according to SEQ ID No. 483 or 484 (also referred to herein as "muag") (corresponding to SEQ ID No. 1393 of the patent application WO2013/143700), or a homolog, a fragment, or a variant thereof.

The term 'a nucleic acid sequence which is derived from the 3'UTR of a [ . . . ] gene' preferably refers to a nucleic acid sequence which is based on the 3'UTR sequence of a [ . . . ] gene or on a part thereof, such as on the 3'UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'UTR sequence, i.e. the full length 3'UTR sequence of a gene, and sequences corresponding to a fragment of the 3'UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term 'a nucleic acid sequence which is derived from a variant of the 3'UTR of a [ . . . ] gene' preferably refers to a nucleic acid sequence, which is based on a variant of the 3'UTR sequence of a gene, such as on a variant of the 3'UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'UTR of a gene, i.e. the full length variant 3'UTR sequence of a gene, and sequences corresponding to a fragment of the variant 3'UTR sequence of a gene. A fragment in this context preferably consists of a continuous stretch of nucleotides corresponding to a continuous stretch of nucleotides in the full-length variant 3'UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'UTR. Such a fragment of a variant, in the sense of the present invention, is preferably a functional fragment of a variant as described herein.

Preferably, the at least one 5'UTR element and the at least one 3'UTR element act synergistically to increase protein production from the inventive artificial nucleic acid as described above.

In a particularly preferred embodiment, the inventive artificial nucleic acid as described herein comprises a histone stem-loop sequence/structure (histone stem-loop). Such histone stem-loop sequences are preferably selected from histone stem-loop sequences as disclosed in WO 2012/019780, whose disclosure is incorporated herewith by reference.

In this context, it is preferred that the artificial nucleic acid comprises at least one histone stem-loop, which is heterologous with respect to the at least one coding region. More preferably, the artificial nucleic acid comprises at least one histone stem-loop, which comprises or consists of a nucleic acid sequence, preferably as described herein, which is not derived from a Zika virus or from another flavivirus.

A histone stem-loop sequence, suitable to be used within the present invention, is preferably selected from at least one of the following formulae (I) or (II):

formula (I)

(stem-loop sequence without stem bordering elements):

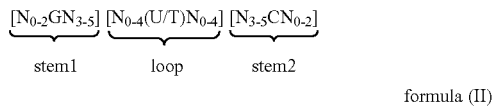

stem1   loop   stem2 formula (II)

(stem-loop sequence with stem bordering elements):

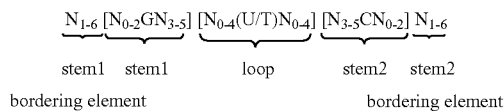

stem1   stem1        loop        stem2   stem2
bordering element                        bordering element wherein:
stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;
stem1 $[N_{0-2} GN_{3-5}]$ is reverse complementary or partially reverse complementary with element stem2, and is a consecutive sequence between of 5 to 7 nucleotides;
  wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and
  wherein G is guanosine or an analogue thereof, and may be optionally replaced by a cytidine or an analogue thereof, provided that its complementary nucleotide cytidine in stem2 is replaced by guanosine;
loop sequence $[N_{0-4}(U/T)N_{0-4}]$ is located between elements stem1 and stem2, and is a consecutive sequence of 3 to 5 nucleotides, more preferably of 4 nucleotides;
  wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and
  wherein U/T represents uridine, or optionally thymidine;
stem2 $[N_{3-5} CN_{0-2}]$ is reverse complementary or partially reverse complementary with element stem1, and is a consecutive sequence between of 5 to 7 nucleotides;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;
  wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and
  wherein C is cytidine or an analogue thereof, and may be optionally replaced by a guanosine or an analogue thereof provided that its complementary nucleoside guanosine in stem1 is replaced by cytidine;
wherein
stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment of the first inventive aspect, the inventive artificial nucleic acid may comprise at least one histone stem-loop sequence according to at least one of the following specific formulae (Ia) or (IIa):

formula (Ia)

(stem-loop sequence without stem bordering elements):

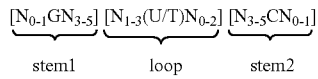

stem1   loop   stem2 formula (IIa)

(stem-loop sequence with stem bordering elements):

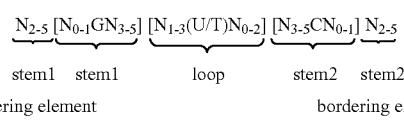

stem1   stem1        loop        stem2   stem2
bordering element                        bordering element wherein:

N, C, G, T and U are as defined above.

According to a further more particularly preferred embodiment of the first aspect, the inventive artificial nucleic acid may comprise at least one histone stem-loop sequence according to at least one of the following specific formulae (Ib) or (IIb):

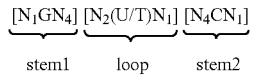

formula (Ib)

(stem-loop sequence without stem bordering elements):

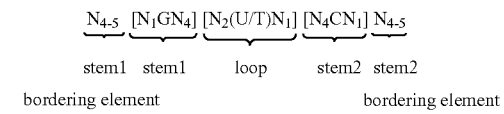

formula (IIb)

(stem-loop sequence with stem bordering elements):

wherein:

N, C, G, T and U are as defined above.

A particular preferred histone stem-loop sequence is the nucleic acid sequence according to SEQ ID NO: 487 or more preferably the corresponding RNA sequence according to SEQ ID NO: 488.

According to another particularly preferred embodiment, the inventive artificial nucleic acid may additionally or alternatively encode a secretory signal peptide (signal sequence). Such signal peptides are sequences, which typically exhibit a length of about 10 to 30 amino acids and are preferably located at the N-terminus of the encoded peptide, without being limited thereto. Signal peptides as defined herein preferably allow the transport of the at least one protein encoded by the at least one coding region of the inventive artificial nucleic acid into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulins as defined herein, signal sequences of the invariant chain of immunoglobulins or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. More preferably, signal sequences of MHC class I molecule HLA-A*0201 may be used according to the present invention.

Any of the above modifications may be applied to the artificial nucleic acid of the present invention, and further to any nucleic acid as used in the context of the present invention and may be, if suitable or necessary, be combined with each other in any combination, provided, these combinations of modifications do not interfere with each other in the artificial nucleic acid. A person skilled in the art will be able to take his choice accordingly.

The artificial nucleic acid as defined herein, may preferably comprise a 5' UTR, a coding region encoding the at least one polypeptide comprising at least one Zika virus protein as described herein, or a fragment, variant or derivative thereof; and/or a 3' UTR preferably containing at least one histone stem-loop. The 3' UTR of the artificial nucleic acid preferably comprises also a poly(A) and/or a poly(C) sequence as defined herewithin. The single elements of the 3' UTR may occur therein in any order from 5' to 3' along the sequence of the artificial nucleic acid. In addition, further elements as described herein, may also be contained, such as a stabilizing sequence as defined herewithin (e.g. derived from the UTR of a globin gene), IRES sequences, etc. Each of the elements may also be repeated in the artificial nucleic acid according to the invention at least once (particularly in di- or multicistronic constructs), preferably twice or more. As an example, the single elements may be present in the artificial nucleic acid in the following order:

5'-coding region-histone stem-loop-poly(A)/(C) sequence-3'; or

5'-coding region-poly(A)/(C) sequence-histone stem-loop-3'; or

5'-coding region-histone stem-loop-polyadenylation signal-3'; or

5'-coding region-polyadenylation signal-histone stem-loop-3'; or

5'-coding region-histone stem-loop-histone stem-loop-poly(A)/(C) sequence-3'; or 5'-coding region-histone stem-loop-histone stem-loop-polyadenylation signal-3'; or 5'-coding region-stabilizing sequence-poly(A)/(C) sequence-histone stem-loop-3'; or 5'-coding region-stabilizing sequence-poly(A)/(C) sequence-poly(A)/(C) sequence-histone stem-loop-3'; etc.

In this context, it is particularly preferred that-if, in addition to the at least one encoded polypeptide defined herein, a further peptide or protein is encoded by the artificial nucleic acid—the encoded peptide or protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)). In a preferred embodiment, the artificial nucleic acid according to the invention does not comprise a reporter gene or a marker gene. Preferably, the artificial nucleic acid according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the artificial nucleic acid according to the invention does not encode luciferase. In another embodiment, the artificial nucleic acid according to the invention does not encode GFP or a variant thereof.

According to a preferred embodiment, the inventive artificial nucleic acid comprises or consists of, preferably in 5' to 3' direction, the following elements:
 a) optionally, a 5'-CAP structure, preferably m7GpppN,
 b) a coding region encoding at least one protein comprising at least one Zika virus protein as described herein, or a fragment or variant thereof,
 c) a poly(A) tail, preferably consisting of 10 to 200, 10 to 100, 40 to 80 or 50 to 70 adenosine nucleotides,
 d) a poly(C) tail, preferably consisting of 10 to 200, 10 to 100, 20 to 70, 20 to 60 or 10 to 40 cytosine nucleotides, and
 e) a histone stem-loop, preferably comprising the RNA sequence according to SEQ ID NO. 487 or 488.

More preferably, the artificial nucleic acid according to the invention comprises or consists of, preferably in 5' to 3' direction, the following elements:
- a) optionally, a 5'-CAP structure, preferably m7GpppN,
- b) a coding region encoding at least one protein comprising at least one Zika virus protein as described herein, or a fragment or variant thereof,
- c) a 3'-UTR element comprising a nucleic acid sequence, which is derived from an α-globin gene, preferably comprising the corresponding RNA sequence of the nucleic acid sequence according to SEQ ID NO. 483 or 484, or a homolog, a fragment or a variant thereof,
- d) a poly(A) tail, preferably consisting of 10 to 200, 10 to 100, 40 to 80 or 50 to 70 adenosine nucleotides,
- e) a poly(C) tail, preferably consisting of 10 to 200, 10 to 100, 20 to 70, 20 to 60 or 10 to 40 cytosine nucleotides, and
- f) a histone stem-loop, preferably comprising the RNA sequence according to SEQ ID NO. 487 or 488.

In a preferred embodiment, the artificial nucleic acid according to the invention comprises or consists of a nucleic acid sequence according to any one of SEQ ID NO: 233 to 245, or a fragment or variant of any of these sequences. More preferably, the artificial nucleic acid according to the invention comprises or consists of a nucleic acid sequence, which is at least 80% identical to any one of SEQ ID NO: 233 to 245.

In a further embodiment, the at least one coding region of the artificial nucleic acid preferably comprises a modified nucleic acid sequence. Preferably, the artificial nucleic acid according to the invention comprises or consists of a nucleic acid sequence according to any one of SEQ ID NO: 246 to 287, or a fragment or variant of any of these sequences. More preferably, the artificial nucleic acid according to the invention comprises or consists of a nucleic acid sequence, which is at least 80% identical to any one of SEQ ID NO: 246 to 287.

In a particularly preferred embodiment, the artificial nucleic acid according to the invention comprises or consists of a nucleic acid sequence according to any one of SEQ ID NO: 235, 239, 243, 247, 249, 252, 254, 257, 261, 263, 265, 267, 269 or 271, or a fragment or variant of any of these sequences. More preferably, the artificial nucleic acid according to the invention comprises or consists of a nucleic acid sequence, which is at least 80% identical to any one of SEQ ID NO: 235, 239, 243, 247, 249, 252, 254, 257, 261, 263, 265, 267, 269 or 271.

More preferably, the artificial nucleic acid according to the invention comprises or consists of, preferably in 5' to 3' direction, the following elements:
- a) optionally, a 5'-CAP structure, preferably m7GpppN,
- b) a 5'-UTR element, which comprises or consists of a nucleic acid sequence, which is derived from the 5'-UTR of a TOP gene, preferably comprising a nucleic acid sequence according to SEQ ID NO. 457 or 458, or a homolog, a fragment or a variant thereof,
- c) a coding sequence encoding at least one protein comprising at least one Zika virus protein as described herein, or a fragment or variant thereof,
- d) a 3'-UTR element comprising a nucleic acid sequence, which is derived from an albumin gene, preferably comprising the corresponding RNA sequence of the nucleic acid sequence according to SEQ ID NO. 485 or 486, or a homolog, a fragment or a variant thereof,
- e) a poly(A) tail, preferably consisting of 10 to 200, 10 to 100, 40 to 80 or 50 to 70 adenosine nucleotides,
- f) a poly(C) tail, preferably consisting of 10 to 200, 10 to 100, 20 to 70, 20 to 60 or 10 to 40 cytosine nucleotides, and
- g) a histone stem-loop, preferably comprising the RNA sequence according to SEQ ID NO. 487 or 488.

According to a particularly preferred embodiment, the artificial nucleic acid according to the invention comprises or consists of a nucleic acid sequence according to any one of SEQ ID NO: 288 to 300, or a fragment or variant of any of these sequences. More preferably, the artificial nucleic acid according to the invention comprises or consists of a nucleic acid sequence, which is at least 80% identical to any one of SEQ ID NO: 288 to 300.

In a further embodiment, the at least one coding region of the artificial nucleic acid preferably comprises a modified nucleic acid sequence. Preferably, the artificial nucleic acid according to the invention comprises or consists of a nucleic acid sequence according to any one of SEQ ID NO: 301 to 342, or a fragment or variant of any of these sequences. More preferably, the artificial nucleic acid according to the invention comprises or consists of a nucleic acid sequence, which is at least 80% identical to any one of SEQ ID NO: 301 to 342.

According to a further preferred embodiment, the artificial nucleic acid according to the invention comprises or consists of a nucleic acid sequence according to any one of SEQ ID NO: 290, 294, 298, 302, 304, 307, 309, 312, 316, 318, 320, 322, 324 or 326, or a fragment or variant of any of these sequences. More preferably, the artificial nucleic acid according to the invention comprises or consists of a nucleic acid sequence, which is at least 80% identical to any one of SEQ ID NO: 290, 294, 298, 302, 304, 307, 309, 312, 316, 318, 320, 322, 324 or 326.

In some embodiments, the at least one coding region of the artificial nucleic acid according to the present invention comprises a nucleic acid sequence encoding a molecular tag. More preferably, the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

The artificial nucleic acid according to the invention may be prepared by using any suitable method known in the art, including synthetic methods such as e.g. solid phase synthesis, as well as recombinant and in vitro methods, such as in vitro transcription reactions.

In this context, it is further preferred that the at least one coding sequence of the artificial nucleic acid of the present invention encodes a polyprotein comprising at least one Zika virus protein, or a fragment or variant thereof, wherein the Zika virus protein is selected from
the Zika virus E proteins or E protein fragments/variants listed in Table 1;
the Zika virus ME proteins or ME protein fragments/variants in Table 2,
the Zika virus prME proteins or prME protein fragments/variants listed in Table 3, 4 or 5,
the Zika virus prME or ME proteins or protein fragments/variants listed in Table or 6.

Accordingly, it is preferred that the at least one coding sequence of the artificial nucleic acid comprises a nucleic acid sequence selected from any one of the nucleic acid sequences listed in Table 1, 2, 3, 4, 5 or 6, or a fragment or variant of any one of these nucleic acid sequences. More preferably, the at least one coding sequence of the artificial nucleic acid comprises a nucleic acid sequence selected from any one of the nucleic acid sequences listed in Table 1A, 2A, 3A, 4A, 5A or 6A, or a fragment or variant of any one of these nucleic acid sequences.

In Tables 1 to 6, each row corresponds to a Zika virus protein as identified by the database accession number of the corresponding protein (first column 'NCBI Accession No.'). The second column in Table 1 ("A") indicates the SEQ ID NO: corresponding to the respective amino acid sequence as provided herein (see sequence listing). The SEQ ID NO: corresponding to the nucleic acid sequence of the wild type mRNA encoding the protein is indicated in the third column ('B') of Tables 1 to 6. The fourth column ('C') in Tables 1 to 6 provides the SEQ ID NO:'s corresponding to modified/optimized nucleic acid sequences of the mRNAs as described herein that encode the protein preferably having the amino acid sequence as defined by the SEQ ID NO: indicated in the second column ('A') or by the database entry indicated in the first column ('NCBI Accession No.').

Tables 1A, 2A, 3A, 4A, 5A or 6A correspond to Tables 1, 2, 3, 4, 5 or 6, respectively and contain particularly preferred artificial nucleic acids encoding the proteins identified in Tables 1 to 6. The row number in Tables 1A to 6A corresponds to the row number in Tables 1 to 6, so that the row number in Tables 1A to 6A provides specific information with regard to the protein encoded by the artificial nucleic acids in Tables 1A to 6A. For example, row number 4 in Table 1A identifies the SEQ ID NO:'s corresponding to the artificial nucleic acids (SEQ ID NO: 3028, 3304, 3580, 3856, 4132, 4408, 4684, 4960, 7444, 7720, 7996, 8272, 8548, 8824, 9100, 9376 or SEQ ID NO: 5236, 5512, 5788, 6064, 6340, 6616, 6892, 7168) encoding the protein identified in row number 4 of Table 1 (SEQ ID NO: 544). The first column ('A') and the second column ('B') in the same row of Tables 1A to 6A contain alternative embodiments of artificial nucleic acids encoding the same protein identified by the corresponding row in Tables 1 to 6.

According to one embodiment, the at least one polypeptide encoded by the at least one coding region of the inventive artificial nucleic acid comprises or consists of Zika virus envelope protein (E), or a fragment or variant thereof, preferably as described herein.

TABLE 1

Amino acid sequences of Zika virus E proteins and respective nucleic acid sequences

| Row | column 1 NCBI Accession No. | column 2 A | column 3 B | column 4 C |
|---|---|---|---|---|
| 1 | KU321639.1 | 17 | 69 | 124, 1369, 1645, 1921, 2197, 2473, 2749 |
| 2 | KU312312.1 | 34 | 87 | 143, 1370, 1646, 1922, 2198, 2474, 2750 |
| 3 | AY632535.2 | 51 | 106 | 162, 1371, 1647, 1923, 2199, 2475, 2751 |
| 4 | KU527068.1 | 544 | 820 | 1096, 1372, 1648, 1924, 2200, 2476, 2752 |
| 5 | KU321639.1 | 17 | 69 | 124, 1594, 1870, 2146, 2422, 2698, 2974 |
| 6 | KU312312.1 | 34 | 87 | 143, 1595, 1871, 2147, 2423, 2699, 2975 |
| 7 | AY632535.2 | 51 | 105 | 162, 1596, 1872, 2148, 2424, 2700, 2976 |
| 8 | KU527068.1 | 769 | 1045 | 1321, 1597, 1873, 2149, 2425, 2701, 2977 |
| 9 | KX421193.1 | 770 | 1046 | 1322, 1598, 1874, 2150, 2426, 2702, 2978 |
| 10 | LC002520.1 | 771 | 1047 | 1323, 1599, 1875, 2151, 2427, 2703, 2979 |
| 11 | DQ859059.1 | 772 | 1048 | 1324, 1600, 1876, 2152, 2428, 2704, 2980 |
| 12 | KU963573.2 | 773 | 1049 | 1325, 1601, 1877, 2153, 2429, 2705, 2981 |
| 13 | KY075939.1 | 774 | 1050 | 1326, 1602, 1878, 2154, 2430, 2706, 2982 |
| 14 | KX447516.1 | 775 | 1051 | 1327, 1603, 1879, 2155, 2431, 2707, 2983 |
| 15 | KX447515.1 | 776 | 1052 | 1328, 1604, 1880, 2156, 2432, 2708, 2984 |
| 16 | KU758874.1 | 777 | 1053 | 1329, 1605, 1881, 2157, 2433, 2709, 2985 |
| 17 | KU729218.1 | 778 | 1054 | 1330, 1606, 1882, 2158, 2434, 2710, 2986 |
| 18 | KU501217.1 | 779 | 1055 | 1331, 1607, 1883, 2159, 2435, 2711, 2987 |
| 19 | KU761561.1 | 780 | 1056 | 1332, 1608, 1884, 2160, 2436, 2712, 2988 |
| 20 | KY075937.1 | 781 | 1057 | 1333, 1609, 1885, 2161, 2437, 2713, 2989 |
| 21 | KY014317.1 | 782 | 1058 | 1334, 1610, 1886, 2162, 2438, 2714, 2990 |
| 22 | KU870645.1 | 783 | 1059 | 1335, 1611, 1887, 2163, 2439, 2715, 2991 |
| 23 | KU922923.1 | 784 | 1060 | 1336, 1612, 1888, 2164, 2440, 2716, 2992 |
| 24 | KU497555.1 | 785 | 1061 | 1337, 1613, 1889, 2165, 2441, 2717, 2993 |
| 25 | KU312314.1 | 786 | 1062 | 1338, 1614, 1890, 2166, 2442, 2718, 2994 |
| 26 | KY014314.1 | 787 | 1063 | 1339, 1615, 1891, 2167, 2443, 2719, 2995 |
| 27 | KX447517.1 | 788 | 1064 | 1340, 1616, 1892, 2168, 2444, 2720, 2996 |
| 28 | KU729217.2 | 789 | 1065 | 1341, 1617, 1893, 2169, 2445, 2721, 2997 |
| 29 | KY328290.1 | 790 | 1066 | 1342, 1618, 1894, 2170, 2446, 2722, 2998 |
| 30 | KX087101.3 | 791 | 1067 | 1343, 1619, 1895, 2171, 2447, 2723, 2999 |
| 31 | KY003156.1 | 792 | 1068 | 1344, 1620, 1896, 2172, 2448, 2724, 3000 |
| 32 | KU758876.1 | 793 | 1069 | 1345, 1621, 1897, 2173, 2449, 2725, 3001 |
| 33 | KU926310.1 | 794 | 1070 | 1346, 1622, 1898, 2174, 2450, 2726, 3002 |
| 34 | KU681081.3 | 795 | 1071 | 1347, 1623, 1899, 2175, 2451, 2727, 3003 |
| 35 | KU744693.1 | 796 | 1072 | 1348, 1624, 1900, 2176, 2452, 2728, 3004 |
| 36 | EU545988.1 | 797 | 1073 | 1349, 1625, 1901, 2177, 2453, 2729, 3005 |
| 37 | KY007221.1 | 798 | 1074 | 1350, 1626, 1902, 2178, 2454, 2730, 3006 |
| 38 | KY003152.1 | 799 | 1075 | 1351, 1627, 1903, 2179, 2455, 2731, 3007 |
| 39 | KX694533.2 | 800 | 1076 | 1352, 1628, 1904, 2180, 2456, 2732, 3008 |
| 40 | KX601167.1 | 801 | 1077 | 1353, 1629, 1905, 2181, 2457, 2733, 3009 |
| 41 | KY288905.1 | 802 | 1078 | 1354, 1630, 1906, 2182, 2458, 2734, 3010 |
| 42 | KF268950.1 | 803 | 1079 | 1355, 1631, 1907, 2183, 2459, 2735, 3011 |
| 43 | KF383116.1 | 804 | 1080 | 1356, 1632, 1908, 2184, 2460, 2736, 3012 |
| 44 | KU963574.2 | 805 | 1081 | 1357, 1633, 1909, 2185, 2461, 2737, 3013 |
| 45 | KF383118.1 | 806 | 1082 | 1358, 1634, 1910, 2186, 2462, 2738, 3014 |
| 46 | KX520666.1 | 807 | 1083 | 1359, 1635, 1911, 2187, 2463, 2739, 3015 |
| 47 | KF383120.1 | 808 | 1084 | 1360, 1636, 1912, 2188, 2464, 2740, 3016 |

In a preferred embodiment, the at least one polypeptide encoded by the at least one coding region of the inventive artificial nucleic acid comprises or consists of Zika virus envelope protein (E) as defined by an accession number indicated in the first column ("NCB' Accession No.") in Table 1 or by any one of the amino acid sequences in the second column ("A") in Table 1, (SEQ ID NO: 17, 34, 51, 544 or 769-808), or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by an accession number indicated in the first column ("NCBI Accession No.") in Table 1 or by any one of the amino acid sequences in the second column ("A") in Table 1, (SEQ ID NO: 17, 34, 51, 544 or 769-808), or a fragment or variant of any one of these sequences.

It is further preferred that the at least one coding region of the artificial nucleic acid according to the invention comprises or consists of a nucleic acid sequence as defined by an accession number indicated in the first column ("NCB' Accession No.") in Table 1 or by any one of the nucleic acid sequences in the third column ("B") in Table 1, (SEQ ID NO: 69, 87, 106, 820, 105 or 1045-1084), or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by an accession number indicated in the first column ("NCBI Accession No.") in Table 1 or by any one of the nucleic acid sequences in the third column ("B") in Table 1, (SEQ ID NO: 69, 87, 106, 820, 105 or 1045-1084), or a fragment or variant of any one of these sequences.

It is further preferred that the at least one coding region of the artificial nucleic acid according to the invention comprises or consists of a modified nucleic acid sequence as defined by any one of the nucleic acid sequences in the fourth column ("C") in Table 1 (SEQ ID NO: 124, 143, 162, 1096, 1321-1360, 1369-1372, 1594-1636, 1645-1648, 1870-1912, 1921-1924, 2146-2188, 2197-2200, 2422-2464, 2473-2476, 2698-2740, 2749-2752 or 2974-3016), or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the modified nucleic acid sequences as defined by any one of the nucleic acid sequences in the fourth column ("C") in Table 1 (SEQ ID NO: 124, 143, 162, 1096, 1321-1360, 1369-1372, 1594-1636, 1645-1648, 1870-1912, 1921-1924, 2146-2188, 2197-2200, 2422-2464, 2473-2476, 2698-2740, 2749-2752 or 2974-3016), or a fragment or variant of any one of these sequences.

In some embodiments, the at least one polypeptide encoded by the at least one coding region of the inventive artificial nucleic acid comprises or consists of Zika virus envelope protein (E), or a fragment or variant thereof, wherein the stem region and/or the transmembrane domain was deleted and/or replaced by a corresponding amino acid sequence derived from Japanese Encephalitis Virus (JEV).

The stem region connects domain III of the Zika virus envelope protein to the transmembrane domain. It is believed that the replacement of the endogenous stem region (and/or transmembrane domain) by a stem region (and/or transmembrane domain) derived from Japanese encephalitis virus (JEV) is capable of increasing the production of Zika virus-like particles.

In one embodiment, the at least one polypeptide encoded by the at least one coding region of the inventive artificial nucleic acid comprises or consists of Zika virus envelope protein (E), or a fragment or variant thereof, wherein the stem region and the transmembrane domain is replaced by the amino acid sequence according to SEQ ID NO: 10965, or a fragment or variant thereof.

In a preferred embodiment, the at least one polypeptide encoded by the at least one coding region of the inventive artificial nucleic acid comprises or consists of Zika virus envelope protein (E) as defined by any one of the amino acid sequences according to SEQ ID NO: 552-555, 9653-9660, 10976-10983, 9677-9680 or 10984-10991, or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by any one of the amino acid sequences according to SEQ ID NO: 552-555, 9653-9660, 10976-10983, 9677-9680 or 10984-10991, or a fragment or variant of any one of these sequences.

It is further preferred that the at least one coding region of the artificial nucleic acid according to the invention comprises or consists of a nucleic acid sequence as defined by any one of the nucleic acid sequences according to SEQ ID NO: 828-831, 9693-9700, 11000-11007, 9717-9720 or 11008-11015, or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 828-831, 9693-9700, 11000-11007, 9717-9720 or 11008-11015, or a fragment or variant of any one of these sequences.

It is further preferred that the at least one coding region of the artificial nucleic acid according to the invention comprises or consists of a modified nucleic acid sequence as defined by any one of the nucleic acid sequences according to SEQ ID NO: 1104-1107, 9733-9740, 11024-11031, 9757-9760, 11032-11039, 1380-1383, 9773-9780, 11048-11055, 9797-9800, 11056-11063, 1656-1659, 9813-9820, 11072-11079, 9837-9840, 11080-11087, 1932-1935, 9853-9860, 11096-11103, 9877-9880, 11104-11111, 2208-2211, 9893-9900, 11120-11127, 9917-9920, 11128-11135, 2484-2487, 9933-9940, 11144-11151, 9957-9960, 11152-11159, 2760-2763, 9973-9980, 11168-11175, 9997-10000 or 11176-11183, or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 1104-1107, 9733-9740, 11024-11031, 9757-9760, 11032-11039, 1380-1383, 9773-9780, 11048-11055, 9797-9800, 11056-11063, 1656-1659, 9813-9820, 11072-11079, 9837-9840, 11080-11087, 1932-1935, 9853-9860, 11096-11103, 9877-9880, 11104-11111, 2208-2211, 9893-9900, 11120-11127, 9917-9920, 11128-11135, 2484-2487, 9933-9940, 11144-11151, 9957-9960, 11152-11159, 2760-2763, 9973-9980, 11168-11175, 9997-10000 or 11176-11183, or a fragment or variant of any one of these sequences.

According to some embodiments, the at least one polypeptide encoded by the at least one coding region of the inventive artificial nucleic acid comprises or consists of Zika virus envelope protein (E), or a fragment or variant thereof, wherein the fusion loop in domain II is mutated. A highly immunogenic epitope that triggers the production of non-neutralizing antibodies is located in the fusion loop. Point mutations of that epitope in the fusion loop of Zika virus E protein has been introduced in order to trigger immune reactions against other epitopes or antigens that potentially induce the production of neutralizing antibodies. For example, amino acid residue F398 in a Zika virus protein from strain ZikaSPH2015-Brazil, Z1106033-Suriname, MR766-Uganda or Natal RGN may be mutated (e.g. F398S).

In a preferred embodiment, the at least one polypeptide encoded by the at least one coding region of the inventive artificial nucleic acid comprises or consists of Zika virus envelope protein (E) as defined by any one of the amino acid sequences according to SEQ ID NO: 545-548, or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by any one of the amino acid sequences according to SEQ ID NO: 545-548, or a fragment or variant of any one of these sequences.

It is further preferred that the at least one coding region of the artificial nucleic acid according to the invention comprises or consists of a nucleic acid sequence as defined by any one of the nucleic acid sequences according to SEQ ID NO: 821-824, or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 821-824, or a fragment or variant of any one of these sequences.

It is further preferred that the at least one coding region of the artificial nucleic acid according to the invention comprises or consists of a modified nucleic acid sequence as defined by any one of the nucleic acid sequences according to SEQ ID NO: 1097-1100, 1373-1376, 1649-1652, 1925-1928, 2201-2204, 2477-2480 or 2753-2756, or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 1097-1100, 1373-1376, 1649-1652, 1925-1928, 2201-2204, 2477-2480 or 2753-2756, or a fragment or variant of any one of these sequences.

In certain embodiments, it may further be preferred that the at least one polypeptide encoded by the at least one coding region of the inventive artificial nucleic acid comprises or consists of Zika virus envelope protein (E), or a fragment or variant thereof, wherein a glycosylation site, preferably the glycosylation at amino acid position N444 in the Zika virus polyprotein, is mutated. A highly immunogenic epitope that triggers the production of non-neutralizing antibodies is located in the fusion loop. Point mutations of that epitope in the fusion loop of Zika virus E protein has been introduced in order to trigger immune reactions against other epitopes or antigens that potentially induce the production of neutralizing antibodies. For example, amino acid residue N444 in a Zika virus protein from strain ZikaSPH2015-Brazil, Z1106033-Suriname, or Natal RGN may be mutated (e.g. N444Q), so that glycosylation at that site is preferably abolished. It is believed that by introducing such a mutation, the production of neutralizing antibodies against Zika virus E protein can be enhanced.

In a preferred embodiment, the at least one polypeptide encoded by the at least one coding region of the inventive artificial nucleic acid comprises or consists of Zika virus envelope protein (E) as defined by any one of the amino acid sequences according to SEQ ID NO: 549-551, or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by any one of the amino acid sequences according to SEQ ID NO: 549-551, or a fragment or variant of any one of these sequences.

It is further preferred that the at least one coding region of the artificial nucleic acid according to the invention comprises or consists of a nucleic acid sequence as defined by any one of the nucleic acid sequences according to SEQ ID NO: 825-827, or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 825-827, or a fragment or variant of any one of these sequences.

It is further preferred that the at least one coding region of the artificial nucleic acid according to the invention comprises or consists of a modified nucleic acid sequence as defined by any one of the nucleic acid sequences according to SEQ ID NO: 1101-1103, 1377-1379, 1653-1655, 1929-1931, 2205-2207, 2481-2483 or 2757-2759, or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by any one of the nucleic acid sequences according to SEQ ID NO: 1101-1103, 1377-1379, 1653-1655, 1929-1931, 2205-2207, 2481-2483 or 2757-2759, or a fragment or variant of any one of these sequences.

In a particularly preferred embodiment, the at least one polypeptide encoded by the at least one coding region of the inventive artificial nucleic acid comprises or consists of Zika virus envelope protein (E), or a fragment or variant thereof, wherein the at least one coding region comprises or consists of a nucleic acid sequence as defined by any one of the nucleic acid sequences in the first column ("A") in Table 1A (SEQ ID NO: 236, 240, 245, 3028, 244, 3253-3292, 249, 254, 259, 3304, 3529-3568, 3577-3580, 3802-3844, 3853-3856, 4078-4120, 4129-4132, 4354-4396, 4405-4408, 4630-4672, 4681-4684, 4906-4948, 4957-4960, 5182-5224, 7441-7444, 7666-7708, 7717-7720, 7942-7984, 7993-7996, 8218-8260, 8269-8272, 8494-8536, 8545-8548, 8770-8812, 8821-8824, 9046-9088, 9097-9100, 9322-9364, 9373-9376 or 9598-9640), or as defined by any one of the nucleic acid sequences in the second column ("B") in Table 1A (291, 295, 300, 5236, 299, 5461-5500, 304, 309, 314, 5512, 5737-5776, 5785-5788, 6010-6052, 6061-6064, 6286-6328, 6337-6340, 6562-6604, 6613-6616, 6838-6880, 6889-6892, 7114-7156, 7165-7168 or 7390-7432) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 1A (SEQ ID NO: 236, 240, 245, 3028, 244, 3253-3292, 249, 254, 259, 3304, 3529-3568, 3577-3580, 3802-3844, 3853-3856, 4078-4120, 4129-4132, 4354-4396, 4405-4408, 4630-4672, 4681-4684, 4906-4948, 4957-4960, 5182-5224, 7441-7444, 7666-7708, 7717-7720, 7942-7984, 7993-7996, 8218-8260, 8269-8272, 8494-8536, 8545-8548, 8770-8812, 8821-8824, 9046-9088, 9097-9100, 9322-9364, 9373-9376 or 9598-9640), or as defined by any one of the nucleic acid sequences in the second column ("B") in Table 1A (291, 295, 300, 5236, 299, 5461-5500, 304, 309, 314, 5512, 5737-5776, 5785-5788, 6010-6052, 6061-6064, 6286-6328, 6337-6340, 6562-6604, 6613-6616, 6838-6880, 6889-6892, 7114-7156, 7165-7168 or 7390-7432) or a fragment or variant of any one of these sequences.

More preferably, the at least one polypeptide encoded by the at least one coding region of the inventive artificial nucleic acid comprises or consists of Zika virus envelope protein (E), or a fragment or variant thereof, wherein the at least one coding region comprises or consists of a modified nucleic acid sequence as defined by any one of the nucleic acid sequences in the first column ("A") in Table 1A (SEQ ID NO: 249, 254, 259, 3304, 3529-3568, 3577-3580, 3802-3844, 3853-3856, 4078-4120, 4129-4132, 4354-4396, 4405-4408, 4630-4672, 4681-4684, 4906-4948, 4957-4960, 5182-5224, 7717-7720, 7942-7984, 7993-7996, 8218-8260, 8269-8272, 8494-8536, 8545-8548, 8770-8812, 8821-8824, 9046-9088, 9097-9100, 9322-9364, 9373-9376 or 9598-9640), or as defined by any one of the nucleic acid sequences in the second column ("B") in Table 1A (304, 309, 314, 5512, 5737-5776, 5785-5788, 6010-6052, 6061-6064, 6286-6328, 6337-6340, 6562-6604, 6613-6616, 6838-6880, 6889-6892, 7114-7156, 7165-7168 or 7390-7432) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 1A (SEQ ID NO: 249, 254, 259, 3304, 3529-3568, 3577-3580, 3802-3844, 3853-3856, 4078-4120, 4129-4132, 4354-4396, 4405-4408, 4630-4672, 4681-4684, 4906-4948, 4957-4960, 5182-5224, 7717-7720, 7942-7984, 7993-7996, 8218-8260, 8269-8272, 8494-8536, 8545-8548, 8770-8812, 8821-8824, 9046-9088, 9097-9100, 9322-9364, 9373-9376 or 9598-9640), or as defined by any one of the nucleic acid sequences in the second column ("B") in Table 1A (304, 309, 314, 5512, 5737-5776, 5785-5788, 6010-6052, 6061-6064, 6286-6328, 6337-6340, 6562-6604, 6613-6616, 6838-6880, 6889-6892, 7114-7156, 7165-7168 or 7390-7432) or a fragment or variant of any one of these sequences.

TABLE 1A

Nucleic acid sequences encoding Zika virus E protein or a fragment or variant thereof

| Row | column 1 A | column 2 B |
|---|---|---|
| 1 | 230, 249, 3577, 3853, 4129, 4405, 4681, 4957, 7441, 7717, 7993, 8269, 8545, 8821, 9097, 9373 | 291, 304, 5785, 6061, 6337, 6613, 6889, 7165 |
| 2 | 240, 254, 3578, 3854, 4130, 4406, 4682, 4958, 7442, 7718, 7994, 8270, 8546, 8822, 9098, 9374 | 295, 309, 5786, 6062, 6338, 6614, 6890, 7166 |
| 3 | 245, 259, 3579, 3855, 4131, 4407, 4683, 4959, 7443, 7719, 7995, 8271, 8547, 8823, 9099, 9375 | 300, 314, 5787, 6063, 6339, 6615, 6891, 7167 |
| 4 | 3028, 3304, 3580, 3856, 4132, 4408, 4684, 4960, 7444, 7720, 7996, 8272, 8548, 8824, 9100, 9376 | 5236, 5512, 5788, 6064, 6340, 6616, 6892, 7168 |
| 5 | 236, 249, 3802, 4078, 4354, 4630, 4906, 5182, 7666, 7942, 8218, 8494, 8770, 9046, 9322, 9598 | 291, 304, 6010, 6286, 6562, 6838, 7114, 7390 |
| 6 | 240, 254, 3803, 4079, 4355, 4631, 4907, 5183, 7667, 7943, 8219, 8495, 8771, 9047, 9323, 9599 | 295, 309, 6011, 6287, 6563, 6839, 7115, 7391 |
| 7 | 244, 259, 3804, 4080, 4356, 4632, 4908, 5184, 7668, 7944, 8220, 8496, 8772, 9048, 9324, 9600 | 299, 314, 6012, 6288, 6564, 6840, 7116, 7392 |
| 8 | 3253, 3529, 3805, 4081, 4357, 4633, 4909, 5185, 7669, 7945, 8221, 8497, 8773, 9049, 9325, 9601 | 5461, 5737, 6013, 6289, 6565, 6841, 7117, 7393 |
| 9 | 3254, 3530, 3806, 4082, 4358, 4634, 4910, 5186, 7670, 7946, 8222, 8498, 8774, 9050, 9326, 9602 | 5462, 5738, 6014, 6290, 6506, 6842, 7118, 7394 |
| 10 | 3255, 3531, 3807, 4083, 4359, 4635, 4911, 5187, 7671, 7947, 8223, 8499, 8775, 9051, 9327, 9603 | 5463, 5739, 6015, 6291, 6567, 6843, 7119, 7395 |
| 11 | 3256, 3532, 3808, 4084, 4360, 4636, 4912, 5188, 7672, 7948, 8224, 8500, 8776, 9052, 9328, 9604 | 5464, 5740, 6016, 6292, 6568, 6844, 7120, 7396 |
| 12 | 3257, 3533, 3809, 4085, 4361, 4637, 4913, 5189, 7673, 7949, 8225, 8501, 8777, 9053, 9329, 9605 | 5465, 5741, 6017, 6293, 6569, 6845, 7121, 7397 |

TABLE 1A-continued

Nucleic acid sequences encoding Zika virus E protein or a fragment or variant thereof

| Row | column 1 A | column 2 B |
|---|---|---|
| 13 | 3258, 3534, 3810, 4086, 4362, 4638, 4914, 5190, 7674, 7950, 8226, 8502, 8778, 9054, 9330, 9606 | 5466, 5742, 6018, 6294, 6570, 6846, 7122, 7398 |
| 14 | 3259, 3535, 3811, 4087, 4363, 4639, 4915, 5191, 7675, 7951, 8227, 8503, 8779, 9055, 9331, 9607 | 5467, 5743, 6019, 6295, 6571, 6847, 7123, 7399 |
| 15 | 3260, 3536, 3812, 4088, 4364, 4640, 4916, 5192, 7676, 7952, 8228, 8504, 8780, 9056, 9332, 9608 | 5468, 5744, 6020, 6296, 6572, 6848, 7124, 7400 |
| 16 | 3261, 3537, 3813, 4089, 4365, 4641, 4917, 5193, 7677, 7953, 8229, 8505, 8781, 9057, 9333, 9609 | 5469, 5745, 6021, 6297, 6573, 6849, 7125, 7401 |
| 17 | 3262, 3538, 3814, 4090, 4366, 4642, 4918, 5194, 7678, 7954, 8230, 8506, 8782, 9058, 9334, 9610 | 5470, 5746, 6022, 6298, 6574, 6850, 7126, 7402 |
| 18 | 3263, 3539, 3815, 4091, 4367, 4643, 4919, 5195, 7679, 7955, 8231, 8507, 8783, 9059, 9335, 9611 | 5471, 5747, 6023, 6299, 6575, 6851, 7127, 7403 |
| 19 | 3264, 3540, 3816, 4092, 4368, 4644, 4920, 5196, 7680, 7956, 8232, 8508, 8784, 9060, 9336, 9612 | 5472, 5748, 6024, 6300, 6576, 6852, 7128, 7404 |
| 20 | 3265, 3541, 3817, 4093, 4369, 4645, 4921, 5197, 7681, 7957, 8233, 8509, 8785, 9061, 9337, 9613 | 5473, 5749, 6025, 6301, 6577, 6853, 7129, 7405 |
| 21 | 3266, 3542, 3818, 4094, 4370, 4646, 4922, 5198, 7682, 7958, 8234, 8510, 8786, 9062, 9338, 9614 | 5474, 5750, 6026, 6302, 6578, 6854, 7130, 7406 |
| 22 | 3267, 3543, 3819, 4095, 4371, 4647, 4923, 5199, 7683, 7959, 8235, 8511, 8787, 9063, 9339, 9015 | 5475, 5751, 6027, 6303, 6579, 6855, 7131, 7407 |
| 23 | 3268, 3544, 3820, 4096, 4372, 4648, 4924, 5200, 7684, 7960, 8236, 8512, 8788, 9064, 9340, 9616 | 5476, 5752, 6028, 6304, 6580, 6856, 7132, 7408 |
| 24 | 3269, 3545, 3821, 4097, 4373, 4649, 4925, 5201, 7685, 7961, 8237, 8513, 8789, 9065, 9341, 9617 | 5477, 5753, 6029, 6305, 6581, 6857, 7133, 7409 |
| 25 | 3270, 3546, 3822, 4098, 4374, 4650, 4926, 5202, 7686, 7962, 8238, 8514, 8790, 9066, 9342, 9618 | 5478, 5754, 6030, 6306, 6582, 6858, 7134, 7410 |
| 26 | 3271, 3547, 3823, 4099, 4375, 4651, 4927, 5203, 7687, 7963, 8239, 8515, 8791, 9067, 9343, 9619 | 5479, 5755, 6031, 6307, 6583, 6859, 7135, 7411 |
| 27 | 3272, 3548, 3824, 4100, 4376, 4652, 4928, 5204, 7688, 7964, 8240, 8516, 8792, 9068, 9344, 9620 | 5480, 5756, 6032, 6308, 6584, 6860, 7136, 7412 |
| 28 | 3273, 3549, 3825, 4101, 4377, 4653, 4929, 5205, 7689, 7965, 8241, 8517, 8793, 9069, 9345, 9621 | 5481, 5757, 6033, 6309, 6585, 6861, 7137, 7413 |
| 29 | 3274, 3550, 3826, 4102, 4378, 4654, 4930, 5206, 7690, 7966, 8242, 8518, 8794, 9070, 9346, 9622 | 5482, 5758, 6034, 6310, 6586, 6862, 7138, 7414 |
| 30 | 3275, 3551, 3827, 4103, 4379, 4655, 4931, 5207, 7691, 7967, 8243, 8519, 8795, 9071, 9347, 9623 | 5483, 5759, 6035, 6311, 6587, 6863, 7139, 7415 |
| 31 | 3276, 3552, 3828, 4104, 4380, 4656, 4932, 5208, 7692, 7968, 8244, 8520, 8796, 9072, 9348, 9624 | 5484, 5760, 6036, 6312, 6588, 6864, 7140, 7416 |
| 32 | 3277, 3553, 3829, 4105, 4381, 4657, 4933, 5209, 7693, 7969, 8245, 8521, 8797, 9073, 9349, 9625 | 5485, 5761, 6037, 6313, 6589, 6865, 7141, 7417 |
| 33 | 3278, 3554, 3830, 4106, 4382, 4658, 4934, 5210, 7694, 7970, 8246, 8522, 8798, 9074, 9350, 9626 | 5486, 5762, 6038, 6314, 6590, 6866, 7142, 7418 |
| 34 | 3279, 3555, 3831, 4107, 4383, 4659, 4935, 5211, 7695, 7971, 8247, 8523, 8799, 9075, 9351, 9627 | 5487, 5763, 6039, 6315, 6591, 6867, 7143, 7419 |
| 35 | 3280, 3556, 3832, 4108, 4384, 4660, 4936, 5212, 7696, 7972, 8248, 8524, 8800, 9076, 9352, 9628 | 5488, 5764, 6040, 6316, 6592, 6868, 7144, 7420 |
| 36 | 3281, 3557, 3833, 4109, 4385, 4661, 4937, 5213, 7697, 7973, 8249, 8525, 8801, 9077, 9353, 9629 | 5489, 5765, 6041, 6317, 6593, 6869, 7145, 7421 |
| 37 | 3282, 3558, 3834, 4110, 4386, 4662, 4938, 5214, 7698, 7974, 8250, 8526, 8802, 9078, 9354, 9630 | 5490, 5766, 6042, 6318, 6594, 6870, 7146, 7422 |
| 38 | 3283, 3559, 3835, 4111, 4387, 4663, 4939, 5215, 7699, 7975, 8251, 8527, 8803, 9079, 9355, 9631 | 5491, 5787, 6043, 6319, 6595, 6871, 7147, 7423 |
| 39 | 3284, 3560, 3836, 4112, 4388, 4664, 4940, 5216, 7700, 7976, 8252, 8528, 8804, 9080, 9356, 9632 | 5492, 5768, 6044, 6320, 6596, 6872, 7148, 7424 |
| 40 | 3285, 3561, 3837, 4113, 4389, 4665, 4941, 5217, 7701, 7977, 8253, 8529, 8805, 9081, 9357, 9633 | 5493, 5769, 6045, 6321, 6597, 6873, 7149, 7425 |
| 41 | 3286, 3562, 3838, 4114, 4390, 4666, 4942, 5218, 7702, 7978, 8254, 8530, 8806, 9082, 9358, 9634 | 5494, 5770, 6046, 6322, 6598, 6874, 7150, 7426 |
| 42 | 3287, 3563, 3839, 4115, 4391, 4667, 4943, 5219, 7703, 7979, 8255, 8531, 8807, 9083, 9359, 9635 | 5495, 5771, 6047, 6323, 6599, 6875, 7151, 7427 |
| 43 | 3288, 3564, 3840, 4116, 4392, 4668, 4944, 5220, 7704, 7980, 8256, 8532, 8808, 9084, 9360, 9636 | 5496, 5772, 6048, 6324, 6600, 6876, 7152, 7428 |
| 44 | 3289, 3565, 3841, 4117, 4393, 4669, 4945, 5221, 7705, 7981, 8257, 8533, 8809, 9085, 9361, 9637 | 5497, 5773, 6049, 6325, 6601, 6877, 7153, 7429 |
| 45 | 3290, 3566, 3842, 4118, 4394, 4670, 4946, 5222, 7706, 7982, 8258, 8534, 8810, 9086, 9362, 9638 | 5498, 5774, 6050, 6326, 6602, 6878, 7154, 7430 |
| 46 | 3291, 3567, 3843, 4119, 4395, 4671, 4947, 5223, 7707, 7983, 8259, 8535, 8811, 9087, 9363, 9639 | 5499, 5775, 6051, 6327, 6603, 6879, 7155, 7431 |
| 47 | 3292, 3568, 3844, 4120, 4396, 4672, 4948, 5224, 7708, 7984, 8260, 8536, 8812, 9088, 9364, 9640 | 5500, 5776, 6052, 6328, 6604, 6880, 7156, 7432 |

In some embodiments, the at least one polypeptide encoded by the at least one coding region of the inventive artificial nucleic acid comprises or consists of Zika virus membrane protein (M), or a fragment or variant thereof, and of Zika virus envelope protein (E), or a fragment or variant thereof. In this context, a polypeptide comprising or consisting of Zika virus membrane protein (M), or a fragment or variant thereof, and of Zika virus envelope protein (E), or a fragment or variant thereof, is also referred to herein as 'ME protein'.

TABLE 2

Amino acid sequences of Zika virus ME proteins and respective nucleic acid sequences

| Row | column 1 NCBI Accession No. | column 2 A | column 3 B | column 4 C |
|---|---|---|---|---|
| 1 | KU321639.1 | 9665 | 9705 | 9745, 9785, 9825, 9865, 9905, 9945, 9985 |
| 2 | KU312312.1 | 9666 | 9706 | 9746, 9786, 9826, 9866, 9906, 9946, 9986 |
| 3 | AY632535.2 | 9667 | 9707 | 9747, 9787, 9827, 9867, 9907, 9947, 9987 |
| 4 | KU527068.1 | 9668 | 9708 | 9748, 9788, 9828, 9868, 9908, 9948, 9988 |
| 5 | KU321639.1 | 9669 | 9709 | 9749, 9789, 9829, 9869, 9909, 9949, 9989 |
| 6 | KU312312.1 | 9670 | 9710 | 9750, 9790, 9830, 9870, 9910, 9950, 9990 |
| 7 | AY632535.2 | 9671 | 9711 | 9751, 9791, 9831, 9871, 9911, 9951, 9991 |
| 8 | KU527068.1 | 9672 | 9712 | 9752, 9792, 9832, 9872, 9912, 9952, 9992 |
| 9 | KU321639.1 | 9673 | 9713 | 9753, 9793, 9833, 9873, 9913, 9953, 9993 |
| 10 | KU312312.1 | 9674 | 9714 | 9754, 9794, 9834, 9874, 9914, 9954, 9994 |
| 11 | AY632535.2 | 9675 | 9715 | 9755, 9795, 9835, 9875, 9915, 9955, 9995 |
| 12 | KU527068.1 | 9676 | 9716 | 9756, 9796, 9836, 9876, 9916, 9956, 9996 |
| 13 | KU321639.1 | 9677 | 9717 | 9757, 9797, 9837, 9877, 9917, 9957, 9997 |
| 14 | KU312312.1 | 9678 | 9718 | 9758, 9798, 9838, 9878, 9918, 9958, 9998 |
| 15 | AY632535.2 | 9679 | 9719 | 9759, 9799, 9839, 9879, 9919, 9959, 9999 |
| 16 | KU527068.1 | 9680 | 9720 | 9760, 9800, 9840, 9880, 9920, 9960, 10000 |
| 17 | KU321639.1 | 10984 | 11008 | 11032, 11056, 11080, 11104, 11128, 11152, 11176 |
| 18 | KU312312.1 | 10985 | 11009 | 11033, 11057, 11081, 11105, 11129, 11153, 11177 |
| 19 | AY632535.2 | 10986 | 11010 | 11034, 11058, 11082, 11106, 11130, 11154, 11178 |
| 20 | KU527068.1 | 10987 | 11011 | 11035, 11059, 11083, 11107, 11131, 11155, 11179 |
| 21 | KU321639.1 | 10988 | 11012 | 11036, 11060, 11084, 11108, 11132, 11156, 11180 |
| 22 | KU312312.1 | 10989 | 11013 | 11037, 11061, 11085, 11109, 11133, 11157, 11181 |
| 23 | AY632535.2 | 10990 | 11014 | 11038, 11062, 11086, 11110, 11134, 11158, 11182 |
| 24 | KU527068.1 | 10991 | 11015 | 11039, 11063, 11087, 11111, 11135, 11159, 11183 |

In a preferred embodiment, the at least one polypeptide encoded by the at least one coding region of the inventive artificial nucleic acid comprises or consists of Zika virus ME protein as defined by an accession number indicated in the first column ("NCBI Accession No.") in Table 2 or by any one of the amino acid sequences in the second column ("A") in Table 2, (SEQ ID NO: 9665-9680 or 10984-10991), or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by an accession number indicated in the first column ("NCBI Accession No.") in Table 2 or by any one of the amino acid sequences in the second column ("A") in Table 2, (SEQ ID NO: 9665-9680 or 10984-10991), or a fragment or variant of any one of these sequences.

It is further preferred that the at least one coding region of the artificial nucleic acid according to the invention comprises or consists of a nucleic acid sequence as defined by an accession number indicated in the first column ("NCBI Accession No.") in Table 2 or by any one of the nucleic acid sequences in the third column ("B") in Table 2, (SEQ ID NO: 9705-9720 or 11008-11015), or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by an accession number indicated in the first column ("NCBI Accession No.") in Table 2 or by any one of the nucleic acid sequences in the third column ("B") in Table 2, (SEQ ID NO: 9705-9720 or 11008-11015), or a fragment or variant of any one of these sequences.

It is further preferred that the at least one coding region of the artificial nucleic acid according to the invention comprises or consists of a modified nucleic acid sequence as defined by any one of the nucleic acid sequences in the fourth column ("C") in Table 2 (SEQ ID NO: 9745-9760, 11032-11039, 9785-9800, 11056-11063, 9825-9840, 11080-11087, 9865-9880, 11104-11111, 9905-9920, 11128-11135, 9945-9960, 11152-11159, 9985-10000, or 11176-11183), or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the modified nucleic acid sequences as defined by any one of the nucleic acid sequences in the fourth column ("C") in Table 2 (SEQ ID NO: 9745-9760, 11032-11039, 9785-9800, 11056-11063, 9825-9840, 11080-11087, 9865-9880, 11104-11111, 9905-9920, 11128-11135, 9945-9960, 11152-11159, 9985-10000 or 11176-11183), or a fragment or variant of any one of these sequences.

In a particularly preferred embodiment, the at least one polypeptide encoded by the at least one coding region of the inventive artificial nucleic acid comprises or consists of Zika virus protein, preferably ME protein, or a fragment or variant thereof, wherein the at least one coding region comprises or consists of a nucleic acid sequence as defined by any one of the nucleic acid sequences in the first column ("A") in Table 2A (SEQ ID NO: 10025-10040, 11200-11207, 10065-10080, 11224-11231, 10105-10120, 11248-11255, 10145-10160, 11272-11279, 10185-10200, 11296-11303, 10225-10240, 11320-11327, 10265-10280, 11344-11351, 10305-10320, 11368-11375, 10665-10680, 11584-11591, 10705-10720, 11608-11615, 10745-10760, 11632-11639, 10785-10800, 11656-11663, 10825-10840, 11680-11687, 10865-10880, 11704-11711, 10905-10920, 11728-11735, 10945-10960, or 11752-11759), or as defined by any one of the nucleic acid sequences in the second column ("B") in Table 2A (10345-10360, 11392-11399, 10385-10400, 11416-11423, 10425-10440, 11440-11447, 10465-

10480, 11464-11471, 10505-10520, 11488-11495, 10545-10560, 11512-11519, 10585-10600, 11536-11543, 10625-10640, or 11560-11567) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 2A (SEQ ID NO: 10025-10040, 11200-11207, 10065-10080, 11224-11231, 10105-10120, 11248-11255, 10145-10160, 11272-11279, 10185-10200, 11296-11303, 10225-10240, 11320-11327, 10265-10280, 11344-11351, 10305-10320, 11368-11375, 10665-10680, 11584-11591, 10705-10720, 11608-11615, 10745-10760, 11632-11639, 10785-10800, 11656-11663, 10825-10840, 11680-11687, 10865-10880, 11704-11711, 10905-10920, 11728-11735, 10945-10960, or 11752-11759), or as defined by any one of the nucleic acid sequences in the second column ("B") in Table 2A (10345-10360, 11392-11399, 10385-10400, 11416-11423, 10425-10440, 11440-11447, 10465-10480, 11464-11471, 10505-10520, 11488-11495, 10545-10560, 11512-11519, 10585-10600, 11536-11543, 10625-10640, or 11560-11567) or a fragment or variant of any one of these sequences.

More preferably, the at least one polypeptide encoded by the at least one coding region of the inventive artificial nucleic acid comprises or consists of Zika virus protein, preferably ME protein, or a fragment or variant thereof, wherein the at least one coding region comprises or consists of a modified nucleic acid sequence as defined by any one of the nucleic acid sequences in the first column ("A") in Table 2A (10065-10080, 11224-11231, 10105-10120, 11248-11255, 10145-10160, 11272-11279, 10185-10200, 11296-11303, 10225-10240, 11320-11327, 10265-10280, 11344-11351, 10305-10320, 11368-11375, 10705-10720, 11608-11615, 10745-10760, 11632-11639, 10785-10800, 11656-11663, 10825-10840, 11680-11687, 10865-10880, 11704-11711, 10905-10920, 11728-11735, 10945-10960, or 11752-11759), or as defined by any one of the nucleic acid sequences in the second column ("B") in Table 2A (10385-10400, 11416-11423, 10425-10440, 11440-11447, 10465-10480, 11464-11471, 10505-10520, 11488-11495, 10545-10560, 11512-11519, 10585-10600, 11536-11543, 10625-10640, or 11560-11567) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 2A (10065-10080, 11224-11231, 10105-10120, 11248-11255, 10145-10160, 11272-11279, 10185-10200, 11296-11303, 10225-10240, 11320-11327, 10265-10280, 11344-11351, 10305-10320, 11368-11375, 10705-10720, 11608-11615, 10745-10760, 11632-11639, 10785-10800, 11656-11663, 10825-10840, 11680-11687, 10865-10880, 11704-11711, 10905-10920, 11728-11735, 10945-10960, or 11752-11759), or as defined by any one of the nucleic acid sequences in the second column ("B") in Table 2A (10385-10400, 11416-11423, 10425-10440, 11440-11447, 10465-10480, 11464-11471, 10505-10520, 11488-11495, 10545-10560, 11512-11519, 10585-10600, 11536-11543, 10625-10640, or 11560-11567) or a fragment or variant of any one of these sequences.

TABLE 2A

Nucleic acid sequences encoding Zika virus ME protein or a fragment or variant thereof

| Row | column 1 A | column 2 B |
|---|---|---|
| 1 | 10025, 10065, 10105, 10145, 10185, 10225, 10265, 10305, 10665, 10705, 10745, 10785, 10825, 10865, 10905, 10945 | 10345, 10385, 10425, 10465, 10505, 10545, 10585, 10625 |
| 2 | 10026, 10066, 10106, 10146, 10186, 10226, 10266, 10306, 10666, 10706, 10746, 10786, 10826, 10866, 10906, 10946 | 10346, 10386, 10426, 10466, 10506, 10546, 10586, 10626 |
| 3 | 10027, 10067, 10107, 10147, 10187, 10227, 10267, 10307, 10667, 10707, 10747, 10787, 10827, 10867, 10907, 10947 | 10347, 10387, 10427, 10467, 10507, 10547, 10587, 10627 |
| 4 | 10028, 10068, 10108, 10148, 10188, 10228, 10268, 10308, 10668, 10708, 10748, 10788, 10828, 10868, 10908, 10948 | 10348, 10388, 10428, 10468, 10508, 10548, 10588, 10628 |
| 5 | 10029, 10069, 10109, 10149, 10189, 10229, 10269, 10309, 10669, 10709, 10749, 10789, 10829, 10869, 10909, 10949 | 10349, 10389, 10429, 10469, 10509, 10549, 10589, 10629 |
| 6 | 10030, 10070, 10110, 10150, 10190, 10230, 10270, 10310, 10670, 10710, 10750, 10790, 10830, 10870, 10910, 10950 | 10350, 10390, 10430, 10470, 10510, 10550, 10590, 10630 |
| 7 | 10031, 10071, 10111, 10151, 10191, 10231, 10271, 10311, 10671, 10711, 10751, 10791, 10831, 10871, 10911, 10951 | 10351, 10391, 10431, 10471, 10511, 10551, 10591, 10631 |
| 8 | 10032, 10072, 10112, 10152, 10192, 10232, 10272, 10312, 10672, 10712, 10752, 10792, 10832, 10872, 10912, 10952 | 10352, 10392, 10432, 10472, 10512, 10552, 10592, 10632 |
| 9 | 10033, 10073, 10113, 10153, 10193, 10233, 10273, 10313, 10673, 10713, 10753, 10793, 10833, 10873, 10913, 10953 | 10353, 10393, 10433, 10473, 10513, 10553, 10593, 10633 |
| 10 | 10034, 10074, 10114, 10154, 10194, 10234, 10274, 10314, 10674, 10714, 10754, 10794, 10834, 10874, 10914, 10954 | 10354, 10394, 10434, 10474, 10514, 10554, 10594, 10634 |
| 11 | 10035, 10075, 10115, 10155, 10195, 10235, 10275, 10315, 10675, 10715, 10755, 10795, 10835, 10875, 10915, 10955 | 10355, 10395, 10435, 10475, 10515, 10555, 10595, 10635 |
| 12 | 10036, 10076, 10116, 10156, 10196, 10236, 10276, 10316, 10676, 10716, 10756, 10796, 10836, 10876, 10916, 10956 | 10356, 10396, 10436, 10476, 10516, 10556, 10596, 10636 |
| 13 | 10037, 10077, 10117, 10157, 10197, 10237, 10277, 10317, 10677, 10717, 10757, 10797, 10837, 10877, 10917, 10957 | 10357, 10397, 10437, 10477, 10517, 10557, 10597, 10637 |
| 14 | 10038, 10078, 10118, 10158, 10198, 10238, 10278, 10318, 10678, 10718, 10758, 10798, 10838, 10878, 10918, 10958 | 10358, 10398, 10438, 10478, 10518, 10558, 10598, 10638 |
| 15 | 10039, 10079, 10119, 10159, 10199, 10239, 10279, 10319, 10679, 10719, 10759, 10799, 10839, 10879, 10919, 10959 | 10359, 10399, 10439, 10479, 10519, 10559, 10599, 10639 |
| 16 | 10040, 10080, 10120, 10160, 10200, 10240, 10280, 10320, 10680, 10720, 10760, 10800, 10840, 10880, 10920, 10960 | 10360, 10400, 10440, 10480, 10520, 10560, 10600, 10640 |
| 17 | 11200, 11224, 11248, 11272, 11296, 11320, 11344, 11368, 11584, 11608, 11632, 11656, 11680, 11704, 11728, 11752 | 11392, 11416, 11440, 11464, 11488, 11512, 11536, 11560 |
| 18 | 11201, 11225, 11249, 11273, 11297, 11321, 11345, 11369, 11585, 11609, 11633, 11657, 11681, 11705, 11729, 11753 | 11393, 11417, 11441, 11465, 11489, 11513, 11537, 11561 |

TABLE 2A-continued

Nucleic acid sequences encoding Zika virus ME protein or a fragment or variant thereof

| Row | column 1 A | column 2 B |
|---|---|---|
| 19 | 11202, 11226, 11250, 11274, 11298, 11322, 11346, 11370, 11586, 11610, 11634, 11658, 11682, 11706, 11730, 11754 | 11394, 11418, 11442, 11466, 11490, 11514, 11538, 11562 |
| 20 | 11203, 11227, 11251, 11275, 11299, 11323, 11347, 11371, 11587, 11611, 11635, 11659, 11683, 11707, 11731, 11755 | 11395, 11419, 11443, 11467, 11491, 11515, 11539, 11563 |
| 21 | 11204, 11228, 11252, 11276, 11300, 11324, 11348, 11372, 11588, 11612, 11636, 11660, 11684, 11708, 11732, 11756 | 11396, 11420, 11444, 11468, 11492, 11516, 11540, 11564 |
| 22 | 11205, 11229, 11253, 11277, 11301, 11325, 11349, 11373, 11589, 11613, 11637, 11661, 11685, 11709, 11733, 11757 | 11397, 11421, 11445, 11469, 11493, 11517, 11541, 11565 |
| 23 | 11206, 11230, 11254, 11278, 11302, 11326, 11350, 11374, 11590, 11614, 11638, 11662, 11686, 11710, 11734, 11758 | 11398, 11422, 11446, 11470, 11494, 11518, 11542, 11566 |
| 24 | 11207, 11231, 11255, 11279, 11303, 11327, 11351, 11375, 11591, 11615, 11639, 11663, 11687, 11711, 11735, 11759 | 11399, 11423, 11447, 11471, 11495, 11519, 11543, 11567 |

In one embodiment, the at least one polypeptide encoded by the at least one coding region of the inventive artificial nucleic acid comprises or consists of Zika virus premembrane protein (prM), or a fragment or variant thereof, and of Zika virus envelope protein (E), or a fragment or variant thereof. In this context, a polypeptide comprising or consisting of Zika virus premembrane protein (prM), or a fragment or variant thereof, and of Zika virus envelope protein (E), or a fragment or variant thereof, is also referred to herein as 'prME protein'.

One particular type of preferred prME proteins (also referred to as 'prME long') and nucleic acid sequences encoding these proteins are identified in Table 3.

TABLE 3

Amino acid sequences of Zika virus prME proteins (prME long), or fragments or variants thereof, and respective nucleic acid sequences

| Row | column 1 NCBI Accession No. | column 2 A | column 3 B | column 4 C |
|---|---|---|---|---|
| 1 | KU321639.1 | 16 | 68 | 122, 1361, 1637, 1913, 2189, 2465, 2741 |
| 2 | KU312312.1 | 33 | 86 | 141, 1362, 1638, 1914, 2190, 2466, 2742 |
| 3 | AY632535.2 | 50 | 104 | 160, 1363, 1639, 1915, 2191, 2467, 2743 |
| 4 | KU527068.1 | 536 | 812 | 1088, 1364, 1640, 1916, 2192, 2468, 2744 |
| 5 | KU321639.1 | 16 | 68 | 1108, 1384, 1660, 1936, 2212, 2488, 2764 |
| 6 | KU321639.1 | 16 | 67 | 122, 1464, 1740, 2016, 2292, 2568, 2844 |
| 7 | KU312312.1 | 33 | 85 | 141, 1465, 1741, 2017, 2293, 2569, 2845 |
| 8 | AY632535.2 | 50 | 103 | 160, 1466, 1742, 2018, 2294, 2570, 2846 |
| 9 | KU527068.1 | 639 | 915 | 1191, 1467, 1743, 2019, 2295, 2571, 2847 |
| 10 | KU720415.1 | 640 | 916 | 1192, 1468, 1744, 2020, 2296, 2572, 2848 |
| 11 | DQ859059.1 | 641 | 917 | 1193, 1469, 1745, 2021, 2297, 2573, 2849 |
| 12 | KX377335.1 | 642 | 918 | 1194, 1470, 1746, 2022, 2298, 2574, 2850 |
| 13 | LC002520.1 | 643 | 919 | 1195, 1471, 1747, 2023, 2299, 2575, 2851 |
| 14 | KU963573.2 | 644 | 920 | 1196, 1472, 1748, 2024, 2300, 2576, 2852 |
| 15 | KX694534.2 | 645 | 921 | 1197, 1473, 1749, 2025, 2301, 2577, 2853 |
| 16 | KX447520.1 | 646 | 922 | 1198, 1474, 1750, 2026, 2302, 2578, 2854 |
| 17 | KX369547.1 | 647 | 923 | 1199, 1475, 1751, 2027, 2303, 2579, 2855 |
| 18 | KX447515.1 | 648 | 924 | 1200, 1476, 1752, 2028, 2304, 2580, 2856 |
| 19 | KU501217.1 | 649 | 925 | 1201, 1477, 1753, 2029, 2305, 2581, 2857 |
| 20 | KU312314.1 | 650 | 926 | 1202, 1478, 1754, 2030, 2306, 2582, 2858 |
| 21 | KX446950.2 | 651 | 927 | 1203, 1479, 1755, 2031, 2307, 2583, 2859 |
| 22 | KY003157.1 | 652 | 928 | 1204, 1480, 1756, 2032, 2308, 2584, 2860 |
| 23 | KX811222.1 | 653 | 929 | 1205, 1481, 1757, 2033, 2309, 2585, 2861 |
| 24 | KX447516.1 | 654 | 930 | 1206, 1482, 1758, 2034, 2310, 2586, 2862 |
| 25 | KX520666.1 | 655 | 931 | 1207, 1483, 1759, 2035, 2311, 2587, 2863 |
| 26 | KU729218.1 | 656 | 932 | 1208, 1484, 1760, 2036, 2312, 2588, 2864 |
| 27 | KU761561.1 | 657 | 933 | 1209, 1485, 1761, 2037, 2313, 2589, 2865 |
| 28 | KY317938.1 | 658 | 934 | 1210, 1486, 1762, 2038, 2314, 2590, 2866 |
| 29 | KY075939.1 | 659 | 935 | 1211, 1487, 1763, 2039, 2315, 2591, 2867 |
| 30 | KX806557.2 | 660 | 936 | 1212, 1488, 1764, 2040, 2316, 2592, 2868 |
| 31 | KU870645.1 | 661 | 937 | 1213, 1489, 1765, 2041, 2317, 2593, 2869 |
| 32 | KU729217.2 | 662 | 938 | 1214, 1490, 1766, 2042, 2318, 2594, 2870 |
| 33 | KU497555.1 | 663 | 939 | 1215, 1491, 1767, 2043, 2319, 2595, 2871 |
| 34 | KX087101.3 | 664 | 940 | 1216, 1492, 1768, 2044, 2320, 2596, 2872 |
| 35 | KY075932.1 | 665 | 941 | 1217, 1493, 1769, 2045, 2321, 2597, 2873 |
| 36 | KY014317.1 | 666 | 942 | 1218, 1494, 1770, 2046, 2322, 2598, 2874 |
| 37 | KU758876.1 | 667 | 943 | 1219, 1495, 1771, 2047, 2323, 2599, 2875 |
| 38 | KU758874.1 | 668 | 944 | 1220, 1496, 1772, 2048, 2324, 2600, 2876 |
| 39 | KY014314.1 | 669 | 945 | 1221, 1497, 1773, 2049, 2325, 2601, 2877 |
| 40 | KU926310.1 | 670 | 946 | 1222, 1498, 1774, 2050, 2326, 2602, 2878 |
| 41 | KU761560.1 | 671 | 947 | 1223, 1499, 1775, 2051, 2327, 2603, 2879 |
| 42 | KY317939.1 | 672 | 948 | 1224, 1500, 1776, 2052, 2328, 2604, 2880 |
| 43 | KY075937.1 | 673 | 949 | 1225, 1501, 1777, 2053, 2329, 2605, 2881 |
| 44 | LC191864.1 | 674 | 950 | 1226, 1502, 1778, 2054, 2330, 2606, 2882 |
| 45 | KX447517.1 | 675 | 951 | 1227, 1503, 1779, 2055, 2331, 2607, 2883 |
| 46 | KU922923.1 | 676 | 952 | 1228, 1504, 1780, 2056, 2332, 2608, 2884 |

TABLE 3-continued

Amino acid sequences of Zika virus prME proteins (prME long), or fragments or variants thereof, and respective nucleic acid sequences

| Row | column 1 NCBI Accession No. | column 2 A | column 3 B | column 4 C |
|---|---|---|---|---|
| 47 | KY003156.1 | 677 | 953 | 1229, 1505, 1781, 2057, 2333, 2609, 2885 |
| 48 | KU312313.1 | 678 | 954 | 1230, 1506, 1782, 2058, 2334, 2610, 2886 |
| 49 | KY075935.1 | 679 | 955 | 1231, 1507, 1783, 2059, 2335, 2611, 2887 |
| 50 | KY014320.1 | 680 | 956 | 1232, 1508, 1784, 2060, 2336, 2612, 2888 |
| 51 | KX827309.1 | 681 | 957 | 1233, 1509, 1785, 2061, 2337, 2613, 2889 |
| 52 | KU681081.3 | 682 | 958 | 1234, 1510, 1786, 2062, 2338, 2614, 2890 |
| 53 | KU744693.1 | 683 | 959 | 1235, 1511, 1787, 2063, 2339, 2615, 2891 |
| 54 | KY328290.1 | 684 | 960 | 1236, 1512, 1788, 2064, 2340, 2616, 2892 |
| 55 | KX694532.2 | 685 | 961 | 1237, 1513, 1789, 2065, 2341, 2617, 2893 |
| 56 | KU955593.1 | 686 | 962 | 1238, 1514, 1790, 2066, 2342, 2618, 2894 |
| 57 | KY272987.1 | 687 | 963 | 1239, 1515, 1791, 2067, 2343, 2619, 2895 |
| 58 | EU545988.1 | 688 | 964 | 1240, 1516, 1792, 2068, 2344, 2620, 2896 |
| 59 | KU681082.3 | 689 | 965 | 1241, 1517, 1793, 2069, 2345, 2621, 2897 |
| 60 | KX601167.1 | 690 | 966 | 1242, 1518, 1794, 2070, 2346, 2622, 2898 |
| 61 | KX694533.2 | 691 | 967 | 1243, 1519, 1795, 2071, 2347, 2623, 2899 |
| 62 | KY288905.1 | 692 | 968 | 1244, 1520, 1796, 2072, 2348, 2624, 2900 |
| 63 | KF268950.1 | 693 | 969 | 1245, 1521, 1797, 2073, 2349, 2625, 2901 |
| 64 | KF383121.1 | 694 | 970 | 1246, 1522, 1798, 2074, 2350, 2626, 2902 |
| 65 | KF268949.1 | 695 | 971 | 1247, 1523, 1799, 2075, 2351, 2627, 2903 |
| 66 | KU955595.1 | 696 | 972 | 1248, 1524, 1800, 2076, 2352, 2628, 2904 |
| 67 | KF383116.1 | 697 | 973 | 1249, 1525, 1801, 2077, 2353, 2629, 2905 |
| 68 | KU963574.2 | 698 | 974 | 1250, 1526, 1802, 2078, 2354, 2630, 2906 |
| 69 | KX601166.1 | 699 | 975 | 1251, 1527, 1803, 2079, 2355, 2631, 2907 |
| 70 | KF383118.1 | 700 | 976 | 1252, 1528, 1804, 2080, 2356, 2632, 2908 |
| 71 | KF383120.1 | 701 | 977 | 1253, 1529, 1805, 2081, 2357, 2633, 2909 |

A further type of preferred prME proteins (also referred to as 'prME short') and nucleic acid sequences encoding these proteins are identified in Table 4.

TABLE 4

Amino acid sequences of Zika virus prME proteins (prME short) and respective nucleic acid sequences

| Row | column 1 NCBI Accession No. | column 2 A | column 3 B | column 4 C |
|---|---|---|---|---|
| 1 | KU321639.1 | 537 | 813 | 1089, 1365, 1641, 1917, 2193, 2469, 2745 |
| 2 | KU312312.1 | 538 | 814 | 1090, 1366, 1642, 1918, 2194, 2470, 2746 |
| 3 | AY632535.2 | 539 | 815 | 1091, 1367, 1643, 1919, 2195, 2471, 2747 |
| 4 | KU527068.1 | 540 | 816 | 1092, 1368, 1644, 1920, 2196, 2472, 2748 |
| 5 | KU321639.1 | 545 | 821 | 1097, 1373, 1649, 1925, 2201, 2477, 2753 |
| 6 | KU312312.1 | 546 | 822 | 1098, 1374, 1650, 1926, 2202, 2478, 2754 |
| 7 | AY632535.2 | 547 | 823 | 1099, 1375, 1651, 1927, 2203, 2479, 2755 |
| 8 | KU527068.1 | 548 | 824 | 1100, 1376, 1652, 1928, 2204, 2480, 2756 |
| 9 | KU321639.1 | 549 | 825 | 1101, 1377, 1653, 1929, 2205, 2481, 2757 |
| 10 | KU312312.1 | 550 | 826 | 1102, 1378, 1654, 1930, 2206, 2482, 2758 |
| 11 | KU527068.1 | 551 | 827 | 1103, 1379, 1655, 1931, 2207, 2483, 2759 |
| 12 | KU321639.1 | 552 | 828 | 1104, 1380, 1656, 1932, 2208, 2484, 2760 |
| 13 | KU312312.1 | 553 | 829 | 1105, 1381, 1657, 1933, 2209, 2485, 2761 |
| 14 | AY632535.2 | 554 | 830 | 1106, 1382, 1658, 1934, 2210, 2486, 2762 |
| 15 | KU527068.1 | 555 | 831 | 1107, 1383, 1659, 1935, 2211, 2487, 2763 |
| 16 | KU321639.1 | 631 | 907 | 1183, 1459, 1735, 2011, 2287, 2563, 2839 |
| 17 | KU321639.1 | 702 | 978 | 1254, 1530, 1806, 2082, 2358, 2634, 2910 |
| 18 | KU312312.1 | 703 | 979 | 1255, 1531, 1807, 2083, 2359, 2635, 2911 |
| 19 | AY632535.2 | 704 | 980 | 1256, 1532, 1808, 2084, 2360, 2636, 2912 |
| 20 | KU527068.1 | 705 | 981 | 1257, 1533, 1809, 2085, 2361, 2637, 2913 |
| 21 | KX421193.1 | 706 | 982 | 1258, 1534, 1810, 2086, 2362, 2638, 2914 |
| 22 | KX377335.1 | 707 | 983 | 1259, 1535, 1811, 2087, 2363, 2639, 2915 |
| 23 | LC002520.1 | 708 | 984 | 1260, 1536, 1812, 2088, 2364, 2640, 2916 |
| 24 | DQ859059.1 | 709 | 985 | 1261, 1537, 1813, 2089, 2365, 2641, 2917 |
| 25 | KU983573.2 | 710 | 986 | 1262, 1538, 1814, 2090, 2366, 2642, 2918 |
| 26 | KX694534.2 | 711 | 987 | 1263, 1539, 1815, 2091, 2367, 2643, 2919 |
| 27 | KX369547.1 | 712 | 988 | 1264, 1540, 1816, 2092, 2368, 2644, 2920 |
| 28 | KX447515.1 | 713 | 989 | 1265, 1541, 1817, 2093, 2369, 2645, 2921 |
| 29 | KU729218.1 | 714 | 990 | 1266, 1542, 1818, 2094, 2370, 2646, 2922 |
| 30 | KU501217.1 | 715 | 991 | 1267, 1543, 1819, 2095, 2371, 2647, 2923 |
| 31 | KU312314.1 | 716 | 992 | 1268, 1544, 1820, 2096, 2372, 2648, 2924 |
| 32 | KX446950.2 | 717 | 993 | 1269, 1545, 1821, 2097, 2373, 2649, 2925 |
| 33 | KY003157.1 | 718 | 994 | 1270, 1546, 1822, 2098, 2374, 2650, 2926 |
| 34 | KX811222.1 | 719 | 995 | 1271, 1547, 1823, 2099, 2375, 2651, 2927 |
| 35 | KX447516.1 | 720 | 996 | 1272, 1548, 1824, 2100, 2376, 2652, 2928 |
| 36 | KX520666.1 | 721 | 997 | 1273, 1549, 1825, 2101, 2377, 2653, 2929 |
| 37 | KU497555.1 | 722 | 998 | 1274, 1550, 1826, 2102, 2378, 2654, 2930 |
| 38 | KY075939.1 | 723 | 999 | 1275, 1551, 1827, 2103, 2379, 2655, 2931 |

TABLE 4-continued

Amino acid sequences of Zika virus prME proteins (prME short) and respective nucleic acid sequences

| Row | column 1 NCBI Accession No. | column 2 A | column 3 B | column 4 C |
|---|---|---|---|---|
| 39 | KY075932.1 | 724 | 1000 | 1276, 1552, 1828, 2104, 2380, 2656, 2932 |
| 40 | KU870645.1 | 725 | 1001 | 1277, 1553, 1829, 2105, 2381, 2057, 2933 |
| 41 | KU729217.2 | 726 | 1002 | 1278, 1554, 1830, 2106, 2382, 2658, 2934 |
| 42 | KX087101.3 | 727 | 1003 | 1279, 1555, 1831, 2107, 2383, 2659, 2935 |
| 43 | KY014317.1 | 728 | 1004 | 1280, 1556, 1832, 2108, 2384, 2660, 2936 |
| 44 | KU758876.1 | 729 | 1005 | 1281, 1557, 1833, 2109, 2385, 2661, 2937 |
| 45 | KU758874.1 | 730 | 1006 | 1282, 1558, 1834, 2110, 2386, 2662, 2938 |
| 46 | KY317939.1 | 731 | 1007 | 1283, 1559, 1835, 2111, 2387, 2663, 2939 |
| 47 | KY014314.1 | 732 | 1008 | 1284, 1560, 1836, 2112, 2388, 2664, 2940 |
| 48 | KX447517.1 | 733 | 1009 | 1285, 1561, 1837, 2113, 2389, 2665, 2941 |
| 49 | KU926310.1 | 734 | 1010 | 1286, 1562, 1838, 2114, 2390, 2666, 2942 |
| 50 | KU922923.1 | 735 | 1011 | 1287, 1563, 1839, 2115, 2391, 2667, 2943 |
| 51 | KY075937.1 | 736 | 1012 | 1288, 1564, 1840, 2116, 2392, 2668, 2944 |
| 52 | KY003156.1 | 737 | 1013 | 1289, 1565, 1841, 2117, 2393, 2669, 2945 |
| 53 | KU312313.1 | 738 | 1014 | 1290, 1566, 1842, 2118, 2394, 2670, 2946 |
| 54 | KY075935.1 | 739 | 1015 | 1291, 1567, 1843, 2119, 2395, 2671, 2947 |
| 55 | KY014320.1 | 740 | 1016 | 1292, 1568, 1844, 2120, 2396, 2672, 2948 |
| 56 | KY328290.1 | 741 | 1017 | 1293, 1569, 1845, 2121, 2397, 2673, 2949 |
| 57 | KU681081.3 | 742 | 1018 | 1294, 1570, 1846, 2122, 2398, 2674, 2950 |
| 58 | KX827309.1 | 743 | 1019 | 1295, 1571, 1847, 2123, 2399, 2675, 2951 |
| 59 | KU955593.1 | 744 | 1020 | 1296, 1572, 1848, 2124, 2400, 2676, 2952 |
| 60 | KY272987.1 | 745 | 1021 | 1297, 1573, 1849, 2125, 2401, 2677, 2953 |
| 61 | KY007221.1 | 746 | 1022 | 1298, 1574, 1850, 2126, 2402, 2678, 2954 |
| 62 | EU545988.1 | 747 | 1023 | 1299, 1575, 1851, 2127, 2403, 2679, 2955 |
| 63 | KU681082.3 | 748 | 1024 | 1300, 1576, 1852, 2128, 2404, 2680, 2956 |
| 64 | KX601167.1 | 749 | 1025 | 1301, 1577, 1853, 2129, 2405, 2681, 2957 |
| 65 | KX694533.2 | 750 | 1026 | 1302, 1578, 1854, 2130, 2406, 2682, 2958 |
| 66 | KY288905.1 | 751 | 1027 | 1303, 1579, 1855, 2131, 2407, 2683, 2959 |
| 67 | KF268950.1 | 752 | 1028 | 1304, 1580, 1856, 2132, 2408, 2684, 2960 |
| 68 | KF383121.1 | 753 | 1029 | 1305, 1581, 1857, 2133, 2409, 2685, 2961 |
| 69 | KF268949.1 | 754 | 1030 | 1306, 1582, 1858, 2134, 2410, 2686, 2962 |
| 70 | KU955595.1 | 755 | 1031 | 1307, 1583, 1859, 2135, 2411, 2687, 2963 |
| 71 | KF383116.1 | 756 | 1032 | 1308, 1584, 1860, 2136, 2412, 2688, 2964 |
| 72 | KX601166.1 | 757 | 1033 | 1309, 1585, 1861, 2137, 2413, 2689, 2965 |
| 73 | KF383118.1 | 758 | 1034 | 1310, 1586, 1862, 2138, 2414, 2690, 2966 |
| 74 | KX447520.1 | 759 | 1035 | 1311, 1587, 1863, 2139, 2415, 2691, 2967 |
| 75 | KU761561.1 | 760 | 1036 | 1312, 1588, 1864, 2140, 2416, 2692, 2968 |
| 76 | KX806557.2 | 761 | 1037 | 1313, 1589, 1865, 2141, 2417, 2693, 2969 |
| 77 | LC191864.1 | 762 | 1038 | 1314, 1590, 1866, 2142, 2418, 2694, 2970 |
| 78 | KU744693.1 | 763 | 1039 | 1315, 1591, 1867, 2143, 2419, 2695, 2971 |
| 79 | KU963574.2 | 764 | 1040 | 1316, 1592, 1868, 2144, 2420, 2696, 2972 |
| 80 | KF383120.1 | 765 | 1041 | 1317, 1593, 1869, 2145, 2421, 2697, 2973 |
| 81 | KU321639.1 | 9641 | 9681 | 9721, 9761, 9801, 9841, 9881, 9921, 9961 |
| 82 | KU312312.1 | 9642 | 9682 | 9722, 9762, 9802, 9842, 9882, 9922, 9962 |
| 83 | AY632535.2 | 9643 | 9683 | 9723, 9763, 9803, 9843, 9883, 9923, 9963 |
| 84 | KU527068.1 | 9644 | 9684 | 9724, 9764, 9804, 9844, 9884, 9924, 9964 |
| 85 | KU321639.1 | 9645 | 9685 | 9725, 9765, 9805, 9845, 9885, 9925, 9965 |
| 86 | KU312312.1 | 9646 | 9686 | 9726, 9766, 9806, 9846, 9886, 9926, 9966 |
| 87 | AY632535.2 | 9647 | 9687 | 9727, 9767, 9807, 9847, 9887, 9927, 9967 |
| 88 | KU527068.1 | 9648 | 9688 | 9728, 9768, 9808, 9848, 9888, 9928, 9968 |
| 89 | KU321639.1 | 9649 | 9689 | 9729, 9769, 9809, 9849, 9889, 9929, 9969 |
| 90 | KU312312.1 | 9650 | 9690 | 9730, 9770, 9810, 9850, 9890, 9930, 9970 |
| 91 | AY632535.2 | 9651 | 9691 | 9731, 9771, 9811, 9851, 9891, 9931, 9971 |
| 92 | KU527068.1 | 9652 | 9692 | 9732, 9772, 9812, 9852, 9892, 9932, 9972 |
| 93 | KU321639.1 | 9653 | 9693 | 9733, 9773, 9813, 9853, 9893, 9933, 9973 |
| 94 | KU312312.1 | 9654 | 9694 | 9734, 9774, 9814, 9854, 9894, 9934, 9974 |
| 95 | AY632535.2 | 9655 | 9695 | 9735, 9775, 9815, 9855, 9895, 9935, 9975 |
| 96 | KU527068.1 | 9656 | 9696 | 9736, 9776, 9816, 9856, 9896, 9936, 9976 |
| 97 | KU321639.1 | 9657 | 9697 | 9737, 9777, 9817, 9857, 9897, 9937, 9977 |
| 98 | KU312312.1 | 9658 | 9698 | 9738, 9778, 9818, 9858, 9898, 9938, 9978 |
| 99 | AY632535.2 | 9659 | 9699 | 9739, 9779, 9819, 9859, 9899, 9939, 9979 |
| 100 | KU527068.1 | 9660 | 9700 | 9740, 9780, 9820, 9860, 9900, 9940, 9980 |
| 101 | KU321639.1 | 9661 | 9701 | 9741, 9781, 9821, 9861, 9901, 9941, 9981 |
| 102 | KU312312.1 | 9662 | 9702 | 9742, 9782, 9822, 9862, 9902, 9942, 9982 |
| 103 | AY632535.2 | 9663 | 9703 | 9743, 9783, 9823, 9863, 9903, 9943, 9983 |
| 104 | KU527068.1 | 9664 | 9704 | 9744, 9784, 9824, 9864, 9904, 9944, 9984 |
| 105 | KU321639.1 | 10968 | 10992 | 11016, 11040, 11064, 11088, 11112, 11136, 11160 |
| 106 | KU312312.1 | 10969 | 10993 | 11017, 11041, 11065, 11089, 11113, 11137, 11161 |
| 107 | AY632535.2 | 10970 | 10994 | 11018, 11042, 11066, 11090, 11114, 11138, 11162 |
| 108 | KU527068.1 | 10971 | 10995 | 11019, 11043, 11067, 11091, 11115, 11139, 11163 |
| 109 | KU321639.1 | 10972 | 10996 | 11020, 11044, 11068, 11092, 11116, 11140, 11164 |
| 110 | KU312312.1 | 10973 | 10997 | 11021, 11045, 11069, 11093, 11117, 11141, 11165 |

TABLE 4-continued

Amino acid sequences of Zika virus prME proteins (prME short) and respective nucleic acid sequences

| Row | column 1 NCBI Accession No. | column 2 A | column 3 B | column 4 C |
|---|---|---|---|---|
| 111 | AY632535.2 | 10974 | 10998 | 11022, 11046, 11070, 11094, 11118, 11142, 11166 |
| 112 | KU527068.1 | 10975 | 10999 | 11023, 11047, 11071, 11095, 11119, 11143, 11167 |
| 113 | KU321639.1 | 10976 | 11000 | 11024, 11048, 11072, 11096, 11120, 11144, 11168 |
| 114 | KU312312.1 | 10977 | 11001 | 11025, 11049, 11073, 11097, 11121, 11145, 11169 |
| 115 | AY632535.2 | 10978 | 11002 | 11026, 11050, 11074, 11098, 11122, 11146, 11170 |
| 116 | KU527068.1 | 10979 | 11003 | 11027, 11051, 11075, 11099, 11123, 11147, 11171 |
| 117 | KU321639.1 | 10980 | 11004 | 11028, 11052, 11076, 11100, 11124, 11148, 11172 |
| 118 | KU312312.1 | 10981 | 11005 | 11029, 11053, 11077, 11101, 11125, 11149, 11173 |
| 119 | AY632535.2 | 10982 | 11006 | 11030, 11054, 11078, 11102, 11126, 11150, 11174 |
| 120 | KU527068.1 | 10983 | 11007 | 11031, 11055, 11079, 11103, 11127, 11151, 11175 |

A further type of preferred prME proteins (also referred to as 'prME short/HT') and nucleic acid sequences encoding these proteins are identified in Table 5.

TABLE 5

Amino acid sequences of Zika virus prME proteins (prME short/HT) and respective nucleic acid sequences

| Row | column 1 NCBI Accession No. | column 2 A | column 3 B | column 4 C |
|---|---|---|---|---|
| 1 | KU321639.1 | 557 | 833 | 1109, 1385, 1661, 1937, 2213, 2489, 2765 |
| 2 | KU321639.1 | 558 | 834 | 1110, 1386, 1662, 1938, 2214, 2490, 2766 |
| 3 | KU321639.1 | 559 | 835 | 1111, 1387, 1663, 1939, 2215, 2491, 2767 |
| 4 | KU321639.1 | 560 | 836 | 1112, 1388, 1664, 1940, 2216, 2492, 2768 |
| 5 | KU321639.1 | 561 | 837 | 1113, 1389, 1665, 1941, 2217, 2493, 2769 |
| 6 | KU321639.1 | 562 | 838 | 1114, 1390, 1666, 1942, 2218, 2494, 2770 |
| 7 | KU321639.1 | 563 | 839 | 1115, 1391, 1667, 1943, 2219, 2495, 2771 |
| 8 | KU321639.1 | 564 | 840 | 1116, 1392, 1668, 1944, 2220, 2496, 2772 |
| 9 | KU321639.1 | 565 | 841 | 1117, 1393, 1669, 1945, 2221, 2497, 2773 |
| 10 | KU321639.1 | 566 | 842 | 1118, 1394, 1670, 1946, 2222, 2498, 2774 |
| 11 | KU321639.1 | 567 | 843 | 1119, 1395, 1671, 1947, 2223, 2499, 2775 |
| 12 | KU321639.1 | 568 | 844 | 1120, 1396, 1672, 1948, 2224, 2500, 2776 |
| 13 | KU321639.1 | 569 | 845 | 1121, 1397, 1673, 1949, 2225, 2501, 2777 |
| 14 | KU321639.1 | 570 | 846 | 1122, 1398, 1674, 1950, 2226, 2502, 2778 |
| 15 | KU321639.1 | 571 | 847 | 1123, 1399, 1675, 1951, 2227, 2503, 2779 |
| 16 | KU321639.1 | 572 | 848 | 1124, 1400, 1676, 1952, 2228, 2504, 2780 |
| 17 | KU321639.1 | 573 | 849 | 1125, 1401, 1677, 1953, 2229, 2505, 2781 |

TABLE 5-continued

Amino acid sequences of Zika virus prME proteins (prME short/HT) and respective nucleic acid sequences

| Row | column 1 NCBI Accession No. | column 2 A | column 3 B | column 4 C |
|---|---|---|---|---|
| 18 | KU321639.1 | 574 | 850 | 1126, 1402, 1678, 1954, 2230, 2506, 2782 |
| 19 | KU321639.1 | 575 | 851 | 1127, 1403, 1679, 1955, 2231, 2507, 2783 |
| 20 | KU321639.1 | 576 | 852 | 1128, 1404, 1680, 1956, 2232, 2508, 2784 |
| 21 | KU321639.1 | 577 | 853 | 1129, 1405, 1681, 1957, 2233, 2509, 2785 |
| 22 | KU321639.1 | 578 | 854 | 1130, 1406, 1682, 1958, 2234, 2510, 2786 |
| 23 | KU321639.1 | 579 | 855 | 1131, 1407, 1683, 1959, 2235, 2511, 2787 |
| 24 | KU321639.1 | 580 | 856 | 1132, 1408, 1684, 1960, 2236, 2512, 2788 |
| 25 | KU321639.1 | 581 | 857 | 1133, 1409, 1685, 1961, 2237, 2513, 2789 |
| 26 | KU321639.1 | 582 | 858 | 1134, 1410, 1686, 1962, 2238, 2514, 2790 |
| 27 | KU321639.1 | 583 | 859 | 1135, 1411, 1687, 1963, 2239, 2515, 2791 |
| 28 | KU321639.1 | 584 | 860 | 1136, 1412, 1688, 1964, 2240, 2516, 2792 |
| 29 | KU321639.1 | 585 | 861 | 1137, 1413, 1689, 1965, 2241, 2517, 2793 |
| 30 | KU321639.1 | 586 | 862 | 1138, 1414, 1690, 1966, 2242, 2518, 2794 |
| 31 | KU321639.1 | 587 | 863 | 1139, 1415, 1691, 1967, 2243, 2519, 2795 |
| 32 | KU321639.1 | 588 | 864 | 1140, 1416, 1692, 1968, 2244, 2520, 2796 |
| 33 | KU321639.1 | 589 | 865 | 1141, 1417, 1693, 1969, 2245, 2521, 2797 |
| 34 | KU321639.1 | 590 | 866 | 1142, 1418, 1694, 1970, 2246, 2522, 2798 |
| 35 | KU321639.1 | 591 | 867 | 1143, 1419, 1695, 1971, 2247, 2523, 2799 |
| 36 | KU321639.1 | 592 | 868 | 1144, 1420, 1696, 1972, 2248, 2524, 2800 |
| 37 | KU321639.1 | 593 | 869 | 1145, 1421, 1697, 1973, 2249, 2525, 2801 |
| 38 | KU321639.1 | 594 | 870 | 1146, 1422, 1698, 1974, 2250, 2526, 2802 |
| 39 | KU321639.1 | 595 | 871 | 1147, 1423, 1699, 1975, 2251, 2527, 2803 |
| 40 | KU321639.1 | 596 | 872 | 1148, 1424, 1700, 1976, 2252, 2528, 2804 |
| 41 | KU321639.1 | 597 | 873 | 1149, 1425, 1701, 1977, 2253, 2529, 2805 |
| 42 | KU321639.1 | 598 | 874 | 1150, 1426, 1702, 1978, 2254, 2530, 2806 |
| 43 | KU321639.1 | 599 | 875 | 1151, 1427, 1703, 1979, 2255, 2531, 2807 |
| 44 | KU321639.1 | 600 | 876 | 1152, 1428, 1704, 1980, 2256, 2532, 2808 |
| 45 | KU321639.1 | 601 | 877 | 1153, 1429, 1705, 1981, 2257, 2533, 2809 |
| 46 | KU321639.1 | 602 | 878 | 1154, 1430, 1706, 1982, 2258, 2534, 2810 |
| 47 | KU321639.1 | 603 | 879 | 1155, 1431, 1707, 1983, 2259, 2535, 2811 |
| 48 | KU321639.1 | 604 | 880 | 1156, 1432, 1708, 1984, 2260, 2536, 2812 |
| 49 | KU321639.1 | 605 | 881 | 1157, 1433, 1709, 1985, 2261, 2537, 2813 |
| 50 | KU321639.1 | 606 | 882 | 1158, 1434, 1710, 1986, 2262, 2538, 2814 |
| 51 | KU321639.1 | 607 | 883 | 1159, 1435, 1711, 1987, 2263, 2539, 2815 |
| 52 | KU321639.1 | 608 | 884 | 1160, 1436, 1712, 1988, 2264, 2540, 2816 |
| 53 | KU321639.1 | 609 | 885 | 1161, 1437, 1713, 1989, 2265, 2541, 2817 |

TABLE 5-continued

Amino acid sequences of Zika virus prME proteins (prME short/HT) and respective nucleic acid sequences

| Row | column 1 NCBI Accession No. | column 2 A | column 3 B | column 4 C |
|---|---|---|---|---|
| 54 | KU321639.1 | 610 | 886 | 1162, 1438, 1714, 1990, 2266, 2542, 2818 |
| 55 | KU321639.1 | 611 | 887 | 1163, 1439, 1715, 1991, 2267, 2543, 2819 |
| 56 | KU321639.1 | 612 | 888 | 1164, 1440, 1716, 1992, 2268, 2544, 2820 |
| 57 | KU321639.1 | 613 | 889 | 1165, 1441, 1717, 1993, 2269, 2545, 2821 |
| 58 | KU321639.1 | 614 | 899 | 1166, 1442, 1718, 1994, 2270, 2546, 2822 |
| 59 | KU321639.1 | 615 | 891 | 1167, 1443, 1719, 1995, 2271, 2547, 2823 |
| 60 | KU321639.1 | 616 | 892 | 1168, 1444, 1720, 1996, 2272, 2548, 2824 |
| 61 | KU321639.1 | 617 | 893 | 1169, 1445, 1721, 1997, 2273, 2549, 2825 |
| 62 | KU321639.1 | 618 | 894 | 1170, 1446, 1722, 1998, 2274, 2550, 2826 |
| 63 | KU321639.1 | 619 | 895 | 1171, 1447, 1723, 1999, 2275, 2551, 2827 |
| 64 | KU321639.1 | 620 | 896 | 1172, 1448, 1724, 2000, 2276, 2552, 2828 |
| 65 | KU321639.1 | 621 | 897 | 1173, 1449, 1725, 2001, 2277, 2553, 2829 |
| 66 | KU321639.1 | 622 | 898 | 1174, 1450, 1726, 2002, 2278, 2554, 2830 |
| 67 | KU321639.1 | 623 | 899 | 1175, 1451, 1727, 2003, 2278, 2555, 2831 |
| 68 | KU321639.1 | 624 | 900 | 1176, 1452, 1728, 2004, 2280, 2556, 2832 |
| 69 | KU321639.1 | 625 | 901 | 1177, 1453, 1729, 2005, 2281, 2557, 2833 |
| 70 | KU321639.1 | 626 | 902 | 1178, 1454, 1730, 2006, 2282, 2558, 2834 |
| 71 | KU321639.1 | 627 | 903 | 1179, 1455, 1731, 2007, 2283, 2559, 2835 |
| 72 | KU321639.1 | 628 | 904 | 1180, 1456, 1732, 2008, 2284, 2560, 2836 |
| 73 | KU321639.1 | 629 | 905 | 1181, 1457, 1733, 2009, 2285, 2561, 2837 |
| 74 | KU321639.1 | 630 | 906 | 1182, 1458, 1734, 2010, 2286, 2562, 2838 |
| 75 | KU321639.1 | 632 | 908 | 1184, 1460, 1736, 2012, 2288, 2564, 2840 |
| 76 | KU321639.1 | 633 | 999 | 1185, 1461, 1737, 2013, 2289, 2565, 2841 |
| 77 | KU321639.1 | 634 | 910 | 1186, 1462, 1738, 2014, 2290, 2566, 2842 |
| 78 | KU321639.1 | 635 | 911 | 1187, 1463, 1739, 2015, 2291, 2567, 2843 |

In a preferred embodiment, the at least one polypeptide encoded by the at least one coding region of the inventive artificial nucleic acid comprises or consists of Zika virus prME protein as defined by an accession number indicated in the first column ("NCBI Accession No.") in Table 3, 4 or 5, or by any one of the amino acid sequences in the second column ("A") in Table 3 (SEQ ID NO: 16, 33, 50, 536 or 639-701), Table 4 (SEQ ID NO: 537-540, 545-555, 631, 702-765, 9641-9664 or 10968-10983) or Table 5 (SEQ ID NO: 557-630 or 632-635) or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by an accession number indicated in the first column ("NCBI Accession No.") in Table 3, 4 or 5, or by any one of the amino acid sequences in the second column ("A") in Table 3 (SEQ ID NO: 16, 33, 50, 536 or 639-701), Table 4 (SEQ ID NO: 537-540, 545-555, 631, 702-765, 9641-9664 or 10968-10983) or Table 5 (SEQ ID NO: 557-630 or 632-635) or a fragment or variant of any one of these sequences.

It is further preferred that the at least one coding region of the artificial nucleic acid according to the invention comprises or consists of a nucleic acid sequence as defined by an accession number indicated in the first column ("NCBI Accession No.") in Table 3, 4 or 5, or by any one of the nucleic acid sequences in the third column ("B") in Table 3 (SEQ ID NO: 68, 86, 104, 812, 67, 85, 103 or 915-977), Table 4 (SEQ ID NO: 813-816, 821-831, 907, 978-1041, 9681-9704 or 10992-11007) or Table 5 (SEQ ID NO: 833-906 or 908-911), or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by an accession number indicated in the first column ("NCB' Accession No.") in Table 3, 4 or 5, or by any one of the nucleic acid sequences in the third column ("B") in Table 3 (SEQ ID NO: 68, 86, 104, 812, 67, 85, 103 or 915-977), Table 4 (SEQ ID NO: 813-816, 821-831, 907, 978-1041, 9681-9704 or 10992-11007) or Table 5 (SEQ ID NO: 833-906 or 908-911), or a fragment or variant of any one of these sequences.

It is further preferred that the at least one coding region of the artificial nucleic acid according to the invention comprises or consists of a modified nucleic acid sequence as defined by any one of the nucleic acid sequences in the fourth column ("C") in Table 3 (SEQ ID NO: 122, 141, 160, 1088, 1108, 1191-1253, 1361-1364, 1384, 1464-1529, 1637-1640, 1660, 1740-1805, 1913-1916, 1936, 2016-2081, 2189-2192, 2212, 2292-2357, 2465-2468, 2488, 2568-2633, 2741-2744, 2764, or 2844-2909), Table 4 (SEQ ID NO: 1089-1092, 1097-1107, 1183, 1254-1317, 9721-9744, 11016-11031, 1365-1368, 1373-1383, 1459, 1530-1593, 9761-9784, 11040-11055, 1641-1644, 1649-1659, 1735, 1806-1869, 9801-9824, 11064-11079, 1917-1920, 1925-1935, 2011, 2082-2145, 9841-9864, 11088-11103, 2193-2196, 2201-2211, 2287, 2358-2421, 9881-9904, 11112-11127, 2469-2472, 2477-2487, 2563, 2634-2697, 9921-9944, 11136-11151, 2745-2748, 2753-2763, 2839, 2910-2973, 9961-9984, or 11160-11175) or Table 5 (SEQ ID NO: 1109-1182, 1184-1187, 1385-1458, 1460-1463, 1661-1734, 1736-1739, 1937-2010, 2012-2015, 2213-2286, 2288-2291, 2489-2562, 2564-2567, 2765-2838, or 2840-2843), or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the fourth column ("C") in Table 3 (SEQ ID NO: 122, 141, 160, 1088, 1108, 1191-1253, 1361-1364, 1384, 1464-1529, 1637-1640, 1660, 1740-1805, 1913-1916, 1936, 2016-2081, 2189-2192, 2212, 2292-2357, 2465-2468, 2488, 2568-2633, 2741-2744, 2764, or 2844-2909), Table 4 (SEQ ID NO: 1089-1092, 1097-1107, 1183, 1254-1317, 9721-9744, 11016-11031, 1365-1368, 1373-1383, 1459, 1530-1593, 9761-9784, 11040-

11055, 1641-1644, 1649-1659, 1735, 1806-1869, 9801-9824, 11064-11079, 1917-1920, 1925-1935, 2011, 2082-2145, 9841-9864, 11088-11103, 2193-2196, 2201-2211, 2287, 2358-2421, 9881-9904, 11112-11127, 2469-2472, 2477-2487, 2563, 2634-2697, 9921-9944, 11136-11151, 2745-2748, 2753-2763, 2839, 2910-2973, 9961-9984, or 11160-11175) or Table 5 (SEQ ID NO: 1109-1182, 1184-1187, 1385-1458, 1460-1463, 1661-1734, 1736-1739, 1937-2010, 2012-2015, 2213-2286, 2288-2291, 2489-2562, 2564-2567, 2765-2838, or 2840-2843), or a fragment or variant of any one of these sequences.

In a particularly preferred embodiment, the at least one polypeptide encoded by the at least one coding region of the inventive artificial nucleic acid comprises or consists of Zika virus protein, preferably prME protein, or a fragment or variant thereof, wherein the at least one coding region comprises or consists of a nucleic acid sequence as defined by any one of the nucleic acid sequences in the first column ("A") in Table 3A (SEQ ID NO: 235, 239, 243, 3020, 3040, 234, 238, 242, 3123-3185, 247, 252, 257, 3296, 3316, 3399-3461, 3569-3572, 3592, 3672-3737, 3845-3848, 3868, 3948-4013, 4121-4124, 4144, 4224-4289, 4397-4400, 4420, 4500-4565, 4673-4676, 4696, 4776-4841, 4949-4952, 4972, 5052-5117, 7433-7436, 7456, 7536-7601, 7709-7712, 7732, 7812-7877, 7985-7988, 8008, 8088-8153, 8261-8264, 8284, 8364-8429, 8537-8540, 8560, 8640-8705, 8813-8816, 8836, 8916-8981, 9089-9092, 9112, 9192-9257, 9365-9368, 9388, or 9468-9533), or as defined by any one of the nucleic acid sequences in the second column ("B") in Table 3A (290, 294, 298, 5228, 5248, 289, 293, 297, 5331-5393, 302, 307, 312, 5504, 5607-5669, 5777-5780, 5800, 5880-5945, 6053-6056, 6076, 6156-6221, 6329-6332, 6352, 6432-6497, 6605-6608, 6628, 6708-6773, 6881-6884, 6904, 6984-7049, 7157-7160, 7180, or 7260-7325) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 3A (SEQ ID NO: 235, 239, 243, 3020, 3040, 234, 238, 242, 3123-3185, 247, 252, 257, 3296, 3316, 3399-3461, 3569-3572, 3592, 3672-3737, 3845-3848, 3868, 3948-4013, 4121-4124, 4144, 4224-4289, 4397-4400, 4420, 4500-4565, 4673-4676, 4696, 4776-4841, 4949-4952, 4972, 5052-5117, 7433-7436, 7456, 7536-7601, 7709-7712, 7732, 7812-7877, 7985-7988, 8008, 8088-8153, 8261-8264, 8284, 8364-8429, 8537-8540, 8560, 8640-8705, 8813-8816, 8836, 8916-8981, 9089-9092, 9112, 9192-9257, 9365-9368, 9388, or 9468-9533), or as defined by any one of the nucleic acid sequences in the second column ("B") in Table 3A (290, 294, 298, 5228, 5248, 289, 293, 297, 5331-5393, 302, 307, 312, 5504, 5607-5669, 5777-5780, 5800, 5880-5945, 6053-6056, 6076, 6156-6221, 6329-6332, 6352, 6432-6497, 6605-6608, 6628, 6708-6773, 6881-6884, 6904, 6984-7049, 7157-7160, 7180, or 7260-7325) or a fragment or variant of any one of these sequences.

More preferably, the at least one polypeptide encoded by the at least one coding region of the inventive artificial nucleic acid comprises or consists of Zika virus protein, preferably prME protein, or a fragment or variant thereof, wherein the at least one coding region comprises or consists of a modified nucleic acid sequence as defined by any one of the nucleic acid sequences in the first column ("A") in Table 3A (247, 252, 257, 3296, 3316, 3399-3461, 3569-3572, 3592, 3672-3737, 3845-3848, 3868, 3948-4013, 4121-4124, 4144, 4224-4289, 4397-4400, 4420, 4500-4565, 4673-4676, 4696, 4776-4841, 4949-4952, 4972, 5052-5117, 7709-7712, 7732, 7812-7877, 7985-7988, 8008, 8088-8153, 8261-8264, 8284, 8364-8429, 8537-8540, 8560, 8640-8705, 8813-8816, 8836, 8916-8981, 9089-9092, 9112, 9192-9257, 9365-9368, 9388, or 9468-9533), or as defined by any one of the nucleic acid sequences in the second column ("B") in Table 3A (302, 307, 312, 5504, 5607-5669, 5777-5780, 5800, 5880-5945, 6053-6056, 6076, 6156-6221, 6329-6332, 6352, 6432-6497, 6605-6608, 6628, 6708-6773, 6881-6884, 6904, 6984-7049, 7157-7160, 7180, or 7260-7325) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 3A (247, 252, 257, 3296, 3316, 3399-3461, 3569-3572, 3592, 3672-3737, 3845-3848, 3868, 3948-4013, 4121-4124, 4144, 4224-4289, 4397-4400, 4420, 4500-4565, 4673-4676, 4696, 4776-4841, 4949-4952, 4972, 5052-5117, 7709-7712, 7732, 7812-7877, 7985-7988, 8008, 8088-8153, 8261-8264, 8284, 8364-8429, 8537-8540, 8560, 8640-8705, 8813-8816, 8836, 8916-8981, 9089-9092, 9112, 9192-9257, 9365-9368, 9388, or 9468-9533), or as defined by any one of the nucleic acid sequences in the second column ("B") in Table 3A (302, 307, 312, 5504, 5607-5669, 5777-5780, 5800, 5880-5945, 6053-6056, 6076, 6156-6221, 6329-6332, 6352, 6432-6497, 6605-6608, 6628, 6708-6773, 6881-6884, 6904, 6984-7049, 7157-7160, 7180, or 7260-7325) or a fragment or variant of any one of these sequences.

TABLE 3A

Nucleic acid sequences encoding Zika virus prME protein (long) or a fragment or variant thereof

| Row | column 1 A | column 2 B |
|---|---|---|
| 1 | 235, 247, 3569, 3845, 4121, 4397, 4673, 4949, 7433, 7709, 7985, 8261, 8537, 8813, 9089, 9365 | 290, 302, 5777, 6053, 6329, 6605, 6881, 7157 |
| 2 | 239, 252, 3570, 3846, 4122, 4398, 4674, 4950, 7434, 7710, 7986, 8262, 8538, 8814, 9090, 9366 | 294, 307, 5778, 6054, 6330, 6606, 6882, 7158 |
| 3 | 243, 257, 3571, 3847, 4123, 4399, 4675, 4951, 7435, 7711, 7987, 8263, 8539, 8815, 9091, 9367 | 298, 312, 5779, 6055, 6331, 6607, 6883, 7159 |
| 4 | 3020, 3296, 3572, 3848, 4124, 4400, 4676, 4952, 7436, 7712, 7988, 8264, 8540, 8816, 9092, 9368 | 5228, 5504, 5780, 6056, 6332, 6608, 6884, 7160 |
| 5 | 3040, 3316, 3592, 3868, 4144, 4420, 4696, 4972, 7456, 7732, 8008, 8284, 8560, 8836, 9112, 9388 | 5248, 5524, 5800, 6076, 6352, 6628, 6904, 7180 |
| 6 | 234, 247, 3672, 3948, 4224, 4500, 4776, 5052, 7536, 7812, 8088, 8364, 8640, 8916, 9192, 9468 | 289, 302, 5880, 6156, 6432, 6708, 6984, 7260 |
| 7 | 238, 252, 3673, 3949, 4225, 4501, 4777, 5053, 7537, 7813, 8089, 8365, 8641, 8917, 9193, 9469 | 293, 307, 5881, 6157, 6433, 6709, 6985, 7261 |
| 8 | 242, 257, 3674, 3950, 4226, 4502, 4778, 5054, 7538, 7814, 8090, 8366, 8642, 8918, 9194, 9470 | 297, 312, 5882, 6158, 6434, 6710, 6986, 7262 |

TABLE 3A-continued

Nucleic acid sequences encoding Zika virus prME protein (long) or a fragment or variant thereof

| Row | column 1 A | column 2 B |
|---|---|---|
| 9 | 3123, 3399, 3675, 3951, 4227, 4503, 4779, 5055, 7539, 7815, 8091, 8367, 8643, 8918, 9195, 9471 | 5331, 5607, 5883, 6159, 6435, 6711, 6987, 7263 |
| 10 | 3124, 3400, 3676, 3952, 4228, 4504, 4780, 5056, 7540, 7816, 8092, 8368, 8644, 8920, 9196, 9472 | 5332, 5608, 5884, 6160, 6436, 6712, 6988, 7264 |
| 11 | 3125, 3401, 3677, 3953, 4229, 4505, 4781, 5057, 7541, 7817, 8093, 8369, 8645, 8921, 9197, 9473 | 5333, 5609, 5885, 6161, 6437, 6713, 6889, 7265 |
| 12 | 3126, 3402, 3678, 3954, 4230, 4506, 4782, 5058, 7542, 7818, 8094, 8370, 8646, 8922, 9198, 9474 | 5334, 5610, 5886, 6162, 6438, 6714, 6990, 7266 |
| 13 | 3127, 3403, 3679, 3955, 4231, 4507, 4783, 5059, 7543, 7819, 8095, 8371, 8647, 8923, 9199, 9475 | 5335, 5611, 5887, 6163, 6439, 6715, 6991, 7267 |
| 14 | 3128, 3404, 3680, 3956, 4232, 4508, 4784, 5060, 7544, 7820, 8096, 8372, 8648, 8924, 9200, 9476 | 5336, 5612, 5888, 6164, 6440, 6716, 6992, 7268 |
| 15 | 3129, 3405, 3681, 3957, 4233, 4509, 4785, 5061, 7545, 7821, 8097, 8373, 8649, 8925, 9201, 9477 | 5337, 5613, 5889, 6165, 6441, 6717, 6993, 7269 |
| 16 | 3130, 3406, 3682, 3958, 4234, 4510, 4786, 5062, 7546, 7822, 8098, 8374, 8650, 8926, 9202, 9478 | 5338, 5614, 5890, 6166, 6442, 6718, 6994, 7270 |
| 17 | 3131, 3407, 3683, 3959, 4235, 4511, 4787, 5063, 7547, 7823, 8099, 8375, 8651, 8927, 9203, 9479 | 5339, 5615, 5891, 6167, 6443, 6719, 6995, 7271 |
| 18 | 3132, 3408, 3684, 3960, 4236, 4512, 4788, 5064, 7548, 7824, 8100, 8376, 8652, 8928, 9204, 9480 | 5340, 5616, 5892, 6168, 6444, 6720, 6996, 7272 |
| 19 | 3133, 3409, 3685, 3961, 4237, 4513, 4789, 5065, 7549, 7825, 8101, 8377, 8653, 8929, 9205, 9481 | 5341, 5617, 5893, 6169, 6445, 6721, 6997, 7273 |
| 20 | 3134, 3410, 3686, 3962, 4238, 4514, 4790, 5066, 7550, 7826, 8102, 8378, 8654, 8930, 9206, 9482 | 5342, 5618, 5894, 6170, 6446, 6722, 6998, 7274 |
| 21 | 3135, 3411, 3687, 3963, 4239, 4515, 4791, 5067, 7551, 7827, 8103, 8379, 8655, 8931, 9207, 9483 | 5343, 5619, 5895, 6171, 6447, 6723, 6999, 7275 |
| 22 | 3136, 3412, 3688, 3964, 4240, 4516, 4792, 5068, 7552, 7828, 8104, 8380, 8656, 8932, 9208, 9484 | 5344, 5620, 5896, 6172, 6448, 6724, 7000, 7276 |
| 23 | 3137, 3413, 3689, 3965, 4241, 4517, 4793, 5069, 7553, 7829, 8105, 8381, 8657, 8933, 9209, 9485 | 5345, 5621, 5897, 6173, 6449, 6725, 7001, 7277 |
| 24 | 3138, 3414, 3690, 3966, 4242, 4518, 4794, 5070, 7554, 7830, 8106, 8382, 8958, 8934, 9210, 9486 | 5346, 5622, 5898, 6174, 6450, 6726, 7002, 7278 |
| 25 | 3139, 3415, 3691, 3967, 4243, 4519, 4795, 5071, 7555, 7831, 8107, 8383, 8659, 8935, 9211, 9487 | 5347, 5623, 5899, 6175, 6451, 6727, 7003, 7279 |
| 26 | 3140, 3416, 3692, 3968, 4244, 4520, 4796, 5072, 7556, 7832, 8108, 8384, 8660, 8936, 9212, 9488 | 5348, 5624, 5900, 6176, 6452, 6728, 7004, 7280 |
| 27 | 3141, 3417, 3693, 3969, 4245, 4521, 4797, 5073, 7557, 7833, 8109, 8385, 8661, 8937, 9213, 9489 | 5349, 5625, 5901, 6177, 6453, 6729, 7005, 7281 |
| 28 | 3142, 3418, 3694, 3970, 4246, 4522, 4798, 5074, 7558, 7834, 8110, 8386, 8662, 8938, 9214, 9490 | 5350, 5626, 5902, 6178, 6454, 6730, 7006, 7282 |
| 29 | 3143, 3419, 3695, 3971, 4247, 4523, 4799, 5075, 7559, 7835, 8111, 8387, 8663, 8939, 9215, 9491 | 5351, 5627, 5903, 6179, 6455, 6731, 7007, 7283 |
| 30 | 3144, 3420, 3696, 3972, 4248, 4524, 4800, 5076, 7560, 7836, 8112, 8388, 8664, 8940, 9216, 9492 | 5352, 5628, 5904, 6180, 6456, 6732, 7008, 7284 |
| 31 | 3145, 3421, 3697, 3973, 4249, 4525, 4801, 5077, 7561, 7837, 8113, 8389, 8665, 8941, 9217, 9493 | 5353, 5629, 5905, 6181, 6457, 6733, 7009, 7285 |
| 32 | 3146, 3422, 3698, 3974, 4250, 4526, 4802, 5078, 7562, 7838, 8114, 8390, 8666, 8942, 9218, 9494 | 5354, 5630, 5906, 6182, 6458, 6734, 7010, 7286 |
| 33 | 3147, 3423, 3699, 3975, 4251, 4527, 4803, 5079, 7563, 7839, 8115, 8391, 8667, 8943, 9219, 9495 | 5355, 5631, 5907, 6183, 6459, 6735, 7011, 7287 |
| 34 | 3148, 3424, 3700, 3976, 4252, 4528, 4804, 5080, 7564, 7840, 8116, 8392, 8668, 8944, 9220, 9496 | 5356, 5632, 5908, 6184, 6460, 6736, 7012, 7288 |
| 35 | 3149, 3425, 3701, 3977, 4253, 4529, 4805, 5081, 7565, 7841, 8117, 8393, 8669, 8945, 9221, 9497 | 5357, 5633, 5909, 6185, 6461, 6737, 7013, 7289 |
| 36 | 3150, 3426, 3702, 3978, 4254, 4530, 4806, 5082, 7566, 7842, 8118, 8394, 8670, 8946, 9222, 9498 | 5358, 5634, 5910, 6186, 6462, 6738, 7014, 7290 |
| 37 | 3151, 3427, 3703, 3979, 4255, 4531, 4807, 5083, 7567, 7843, 8119, 8395, 8671, 8947, 9223, 9499 | 5359, 5635, 5911, 6187, 6463, 6739, 7015, 7291 |
| 38 | 3152, 3428, 3704, 3980, 4256, 4532, 4808, 5084, 7568, 7844, 8120, 8396, 8672, 8948, 9224, 9500 | 5360, 5636, 5912, 6188, 6464, 6740, 7016, 7292 |
| 39 | 3153, 3429, 3705, 3981, 4257, 4533, 4809, 5085, 7569, 7845, 8121, 8397, 8673, 8949, 9225, 9501 | 5361, 5637, 5913, 6189, 6465, 6741, 7017, 7293 |
| 40 | 3154, 3430, 3706, 3982, 4258, 4534, 4810, 5086, 7570, 7846, 8122, 8398, 8674, 8950, 9226, 9502 | 5362, 5638, 5914, 6190, 6466, 6742, 7018, 7294 |
| 41 | 3155, 3431, 3707, 3983, 4259, 4535, 4811, 5087, 7571, 7847, 8123, 8399, 8675, 8951, 9227, 9503 | 5363, 5639, 5915, 6191, 6467, 6743, 7019, 7295 |
| 42 | 3156, 3432, 3708, 3984, 4260, 4536, 4812, 5088, 7572, 7848, 8124, 8400, 8676, 8952, 9228, 9504 | 5364, 5640, 5916, 6192, 6468, 6744, 7020, 7296 |
| 43 | 3157, 3433, 3709, 3985, 4261, 4537, 4813, 5089, 7573, 7849, 8125, 8401, 8677, 8953, 9229, 9505 | 5365, 5641, 5917, 6193, 6469, 6745, 7021, 7297 |
| 44 | 3158, 3434, 3710, 3986, 4262, 4538, 4814, 5090, 7574, 7850, 8126, 8402, 8678, 8954, 9230, 9506 | 5366, 5642, 5918, 6194, 6470, 6746, 7022, 7298 |

TABLE 3A-continued

Nucleic acid sequences encoding Zika virus prME protein (long) or a fragment or variant thereof

| Row | column 1 A | column 2 B |
|---|---|---|
| 45 | 3159, 3435, 3711, 3987, 4263, 4539, 4815, 5091, 7575, 7851, 8127, 8403, 8679, 8955, 9231, 9507 | 5367, 5643, 5919, 6195, 6471, 6747, 7023, 7299 |
| 46 | 3160, 3436, 3712, 3988, 4264, 4540, 4816, 5092, 7576, 7852, 8128, 8404, 8680, 8956, 9232, 9508 | 5368, 5644, 5920, 6196, 6472, 6748, 7024, 7300 |
| 47 | 3161, 3437, 3713, 3989, 4265, 4541, 4817, 5093, 7577, 7853, 8129, 8405, 8681, 8957, 9233, 9509 | 5369, 5645, 5921, 6197, 6473, 6749, 7025, 7301 |
| 48 | 3162, 3438, 3714, 3990, 4266, 4542, 4818, 5094, 7578, 7854, 8130, 8406, 8682, 8958, 9234, 9510 | 5370, 5646, 5922, 6198, 6474, 6750, 7026, 7302 |
| 49 | 3163, 3439, 3715, 3991, 4267, 4543, 4819, 5095, 7579, 7855, 8131, 8407, 8683, 8959, 9235, 9511 | 5371, 5647, 5923, 6199, 6475, 6751, 7027, 7303 |
| 50 | 3164, 3440, 3716, 3992, 4268, 4544, 4820, 5096, 7580, 7856, 8132, 8408, 8684, 8960, 9236, 9512 | 5372, 5648, 5924, 6200, 6476, 6752, 7028, 7304 |
| 51 | 3165, 3441, 3717, 3993, 4269, 4545, 4821, 5097, 7581, 7857, 8133, 8409, 8685, 8961, 9237, 9513 | 5373, 5649, 5925, 6201, 6477, 6753, 7029, 7305 |
| 52 | 3166, 3442, 3718, 3994, 4270, 4546, 4822, 5098, 7582, 7858, 8134, 8410, 8686, 8962, 9238, 9514 | 5374, 5650, 5926, 6202, 6478, 6754, 7030, 7306 |
| 53 | 3167, 3443, 3719, 3995, 4271, 4547, 4823, 5099, 7583, 7859, 8135, 8411, 8687, 8963, 9239, 9515 | 5375, 5651, 5927, 6203, 6479, 6755, 7031, 7307 |
| 54 | 3168, 3444, 3720, 3996, 4272, 4548, 4824, 5100, 7584, 7860, 8136, 8412, 8688, 8964, 9240, 9516 | 5376, 5652, 5928, 6204, 6480, 6756, 7032, 7308 |
| 55 | 3169, 3445, 3721, 3997, 4273, 4549, 4825, 5101, 7585, 7861, 8137, 8413, 8689, 8965, 9241, 9517 | 5377, 5653, 5929, 6205, 6481, 6757, 7033, 7309 |
| 56 | 3170, 3446, 3722, 3998, 4274, 4550, 4826, 5102, 7586, 7862, 8138, 8414, 8690, 8966, 9242, 9518 | 5378, 5654, 5930, 6206, 6482, 6758, 7034, 7310 |
| 57 | 3171, 3447, 3723, 3999, 4275, 4551, 4827, 5103, 7587, 7863, 8139, 8415, 8691, 8967, 9243, 9519 | 5379, 5655, 5931, 6207, 6483, 6759, 7035, 7311 |
| 58 | 3172, 3448, 3724, 4000, 4276, 4552, 4828, 5104, 7588, 7864, 8140, 8416, 8692, 8968, 9244, 9520 | 5380, 5656, 5932, 6208, 6484, 6760, 7036, 7312 |
| 59 | 3173, 3449, 3725, 4001, 4277, 4553, 4829, 5105, 7589, 7865, 8141, 8417, 8693, 8969, 9245, 9521 | 5381, 5657, 5933, 6209, 6485, 6761, 7037, 7313 |
| 60 | 3174, 3450, 3726, 4002, 4278, 4554, 4830, 5106, 7590, 7866, 8142, 8418, 8694, 8970, 9246, 9522 | 5382, 5658, 5934, 6210, 6486, 6762, 7038, 7314 |
| 61 | 3175, 3451, 3727, 4003, 4279, 4555, 4831, 5107, 7591, 7867, 8143, 8419, 8695, 8971, 9247, 9523 | 5383, 5659, 5935, 6211, 6487, 6763, 7039, 7315 |
| 62 | 3176, 3452, 3728, 4004, 4280, 4556, 4832, 5108, 7592, 7868, 8144, 8420, 8696, 8972, 9248, 9524 | 5384, 5660, 5936, 6212, 6488, 6764, 7040, 7316 |
| 63 | 3177, 3453, 3729, 4005, 4281, 4557, 4833, 5109, 7593, 7869, 8145, 8421, 8697, 8973, 9249, 9525 | 5385, 5661, 5937, 6213, 6489, 6765, 7041, 7317 |
| 64 | 3178, 3454, 3730, 4006, 4282, 4558, 4834, 5110, 7594, 7870, 8146, 8422, 8698, 8974, 9250, 9526 | 5386, 5662, 5938, 6214, 6490, 6766, 7042, 7318 |
| 65 | 3179, 3455, 3731, 4007, 4283, 4559, 4835, 5111, 7595, 7871, 8147, 8423, 8699, 8975, 9251, 9527 | 5387, 5663, 5939, 6215, 6491, 6767, 7043, 7319 |
| 66 | 3180, 3456, 3732, 4008, 4284, 4560, 4836, 5112, 7596, 7872, 8148, 8424, 8700, 8976, 9252, 9528 | 5388, 5664, 5940, 6216, 6492, 6768, 7044, 7320 |
| 67 | 3181, 3457, 3733, 4009, 4285, 4561, 4837, 5113, 7597, 7873, 8149, 8425, 8701, 8977, 9253, 9529 | 5389, 5665, 5941, 6217, 6493, 6769, 7045, 7321 |
| 68 | 3182, 3458, 3734, 4010, 4286, 4562, 4838, 5114, 7598, 7874, 8150, 8426, 8702, 8978, 9254, 9530 | 5390, 5666, 5942, 6218, 6494, 6770, 7046, 7322 |
| 69 | 3183, 3459, 3735, 4011, 4287, 4563, 4839, 5115, 7599, 7875, 8151, 8427, 8703, 8979, 9255, 9531 | 5391, 5667, 5943, 6219, 6495, 6771, 7047, 7323 |
| 70 | 3184, 3460, 3736, 4012, 4288, 4564, 4840, 5116, 7600, 7876, 8152, 8428, 8704, 8980, 9256, 9532 | 5392, 5668, 5944, 6220, 6496, 6772, 7048, 7324 |
| 71 | 3185, 3461, 3737, 4013, 4289, 4565, 4841, 5117, 7601, 7877, 8153, 8429, 8705, 8981, 9257, 9533 | 5393, 5669, 5945, 6221, 6497, 6773, 7049, 7325 |

In a particularly preferred embodiment, the at least one polypeptide encoded by the at least one coding region of the inventive artificial nucleic acid comprises or consists of Zika virus protein, preferably prME protein, or a fragment or variant thereof, wherein the at least one coding region comprises or consists of a nucleic acid sequence as defined by any one of the nucleic acid sequences in the first column ("A") in Table 4A (SEQ ID NO: 3021-3024, 3029-3039, 3115, 3186-3249, 10001-10024, 11184-11199, 3297-3300, 3305-3315, 3391, 3462-3525, 10041-10064, 11208-11223, 3573-3576, 3581-3591, 3667, 3738-3801, 10081-10104, 11232-11247, 3849-3852, 3857-3867, 3943, 4014-4077, 10121-10144, 11256-11271, 4125-4128, 4133-4143, 4219, 4290-4353, 10161-10184, 11280-11295, 4401-4404, 4409-4419, 4495, 4566-4629, 10201-10224, 11304-11319, 4677-4680, 4685-4695, 4771, 4842-4905, 10241-10264, 11328-11343, 4953-4956, 4961-4971, 5047, 5118-5181, 10281-10304, 11352-11367, 7437-7440, 7445-7455, 7531, 7602-7665, 10641-10664, 11568-11583, 7713-7716, 7721-7731, 7807, 7878-7941, 10681-10704, 11592-11607, 7989-7992, 7997-8007, 8083, 8154-8217, 10721-10744, 11616-11631, 8265-8268, 8273-8283, 8359, 8430-8493, 10761-10784, 11640-11655, 8541-8544, 8549-8559, 8635, 8706-8769, 10801-10824, 11664-11679, 8817-8820, 8825-8835, 8911, 8982-9045, 10841-10864, 11688-11703, 9093-9096, 9101-9111, 9187, 9258-9321, 10881-10904, 11712-11727, 9369-9372, 9377-9387, 9463, 9534-9597, 10921-10944, or 11736-11751), or as defined by any one of the nucleic acid sequences in the second column ("B") in Table 4A (5229-5232, 5237-5247, 5323, 5394-5457, 10321-10344, 11376-

11391, 5505-5508, 5513-5523, 5599, 5670-5733, 10361-10384, 11400-11415, 5781-5784, 5789-5799, 5875, 5946-6009, 10401-10424, 11424-11439, 6057-6060, 6065-6075, 6151, 6222-6285, 10441-10464, 11448-11463, 6333-6336, 6341-6351, 6427, 6498-6561, 10481-10504, 11472-11487, 6609-6612, 6617-6627, 6703, 6774-6837, 10521-10544, 11496-11511, 6885-6888, 6893-6903, 6979, 7050-7113, 10561-10584, 11520-11535, 7161-7164, 7169-7179, 7255, 7326-7389, 10601-10624, or 11544-11559) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 4A (SEQ ID NO: 3021-3024, 3029-3039, 3115, 3186-3249, 10001-10024, 11184-11199, 3297-3300, 3305-3315, 3391, 3462-3525, 10041-10064, 11208-11223, 3573-3576, 3581-3591, 3667, 3738-3801, 10081-10104, 11232-11247, 3849-3852, 3857-3867, 3943, 4014-4077, 10121-10144, 11256-11271, 4125-4128, 4133-4143, 4219, 4290-4353, 10161-10184, 11280-11295, 4401-4404, 4409-4419, 4495, 4566-4629, 10201-10224, 11304-11319, 4677-4680, 4685-4695, 4771, 4842-4905, 10241-10264, 11328-11343, 4953-4956, 4961-4971, 5047, 5118-5181, 10281-10304, 11352-11367, 7437-7440, 7445-7455, 7531, 7602-7665, 10641-10664, 11568-11583, 7713-7716, 7721-7731, 7807, 7878-7941, 10681-10704, 11592-11607, 7989-7992, 7997-8007, 8083, 8154-8217, 10721-10744, 11616-11631, 8265-8268, 8273-8283, 8359, 8430-8493, 10761-10784, 11640-11655, 8541-8544, 8549-8559, 8635, 8706-8769, 10801-10824, 11664-11679, 8817-8820, 8825-8835, 8911, 8982-9045, 10841-10864, 11688-11703, 9093-9096, 9101-9111, 9187, 9258-9321, 10881-10904, 11712-11727, 9369-9372, 9377-9387, 9463, 9534-9597, 10921-10944, or 11736-11751), or as defined by any one of the nucleic acid sequences in the second column ("B") in Table 4A (5229-5232, 5237-5247, 5323, 5394-5457, 10321-10344, 11376-11391, 5505-5508, 5513-5523, 5599, 5670-5733, 10361-10384, 11400-11415, 5781-5784, 5789-5799, 5875, 5946-6009, 10401-10424, 11424-11439, 6057-6060, 6065-6075, 6151, 6222-6285, 10441-10464, 11448-11463, 6333-6336, 6341-6351, 6427, 6498-6561, 10481-10504, 11472-11487, 6609-6612, 6617-6627, 6703, 6774-6837, 10521-10544, 11496-11511, 6885-6888, 6893-6903, 6979, 7050-7113, 10561-10584, 11520-11535, 7161-7164, 7169-7179, 7255, 7326-7389, 10601-10624, or 11544-11559) or a fragment or variant of any one of these sequences.

More preferably, the at least one polypeptide encoded by the at least one coding region of the inventive artificial nucleic acid comprises or consists of Zika virus protein, preferably prME protein, or a fragment or variant thereof, wherein the at least one coding region comprises or consists of a modified nucleic acid sequence as defined by any one of the nucleic acid sequences in the first column ("A") in Table 4A (3297-3300, 3305-3315, 3391, 3462-3525, 10041-10064, 11208-11223, 3573-3576, 3581-3591, 3667, 3738-3801, 10081-10104, 11232-11247, 3849-3852, 3857-3867, 3943, 4014-4077, 10121-10144, 11256-11271, 4125-4128, 4133-4143, 4219, 4290-4353, 10161-10184, 11280-11295, 4401-4404, 4409-4419, 4495, 4566-4629, 10201-10224, 11304-11319, 4677-4680, 4685-4695, 4771, 4842-4905, 10241-10264, 11328-11343, 4953-4956, 4961-4971, 5047, 5118-5181, 10281-10304, 11352-11367, 7713-7716, 7721-7731, 7807, 7878-7941, 10681-10704, 11592-11607, 7989-7992, 7997-8007, 8083, 8154-8217, 10721-10744, 11616-11631, 8265-8268, 8273-8283, 8359, 8430-8493, 10761-10784, 11640-11655, 8541-8544, 8549-8559, 8635, 8706-8769, 10801-10824, 11664-11679, 8817-8820, 8825-8835, 8911, 8982-9045, 10841-10864, 11688-11703, 9093-9096, 9101-9111, 9187, 9258-9321, 10881-10904, 11712-11727, 9369-9372, 9377-9387, 9463, 9534-9597, 10921-10944, or 11736-11751), or as defined by any one of the nucleic acid sequences in the second column ("B") in Table 4A (5505-5508, 5513-5523, 5599, 5670-5733, 10361-10384, 11400-11415, 5781-5784, 5789-5799, 5875, 5946-6009, 10401-10424, 11424-11439, 6057-6060, 6065-6075, 6151, 6222-6285, 10441-10464, 11448-11463, 6333-6336, 6341-6351, 6427, 6498-6561, 10481-10504, 11472-11487, 6609-6612, 6617-6627, 6703, 6774-6837, 10521-10544, 11496-11511, 6885-6888, 6893-6903, 6979, 7050-7113, 10561-10584, 11520-11535, 7161-7164, 7169-7179, 7255, 7326-7389, 10601-10624, or 11544-11559) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 4A (3297-3300, 3305-3315, 3391, 3462-3525, 10041-10064, 11208-11223, 3573-3576, 3581-3591, 3667, 3738-3801, 10081-10104, 11232-11247, 3849-3852, 3857-3867, 3943, 4014-4077, 10121-10144, 11256-11271, 4125-4128, 4133-4143, 4219, 4290-4353, 10161-10184, 11280-11295, 4401-4404, 4409-4419, 4495, 4566-4629, 10201-10224, 11304-11319, 4677-4680, 4685-4695, 4771, 4842-4905, 10241-10264, 11328-11343, 4953-4956, 4961-4971, 5047, 5118-5181, 10281-10304, 11352-11367, 7713-7716, 7721-7731, 7807, 7878-7941, 10681-10704, 11592-11607, 7989-7992, 7997-8007, 8083, 8154-8217, 10721-10744, 11616-11631, 8265-8268, 8273-8283, 8359, 8430-8493, 10761-10784, 11640-11655, 8541-8544, 8549-8559, 8635, 8706-8769, 10801-10824, 11664-11679, 8817-8820, 8825-8835, 8911, 8982-9045, 10841-10864, 11688-11703, 9093-9096, 9101-9111, 9187, 9258-9321, 10881-10904, 11712-11727, 9369-9372, 9377-9387, 9463, 9534-9597, 10921-10944, or 11736-11751), or as defined by any one of the nucleic acid sequences in the second column ("B") in Table 4A (5505-5508, 5513-5523, 5599, 5670-5733, 10361-10384, 11400-11415, 5781-5784, 5789-5799, 5875, 5946-6009, 10401-10424, 11424-11439, 6057-6060, 6065-6075, 6151, 6222-6285, 10441-10464, 11448-11463, 6333-6336, 6341-6351, 6427, 6498-6561, 10481-10504, 11472-11487, 6609-6612, 6617-6627, 6703, 6774-6837, 10521-10544, 11496-11511, 6885-6888, 6893-6903, 6979, 7050-7113, 10561-10584, 11520-11535, 7161-7164, 7169-7179, 7255, 7326-7389, 10601-10624, or 11544-11559) or a fragment or variant of any one of these sequences.

TABLE 4A

Nucleic acid sequences encoding Zika virus prME protein (prME short) or a fragment or variant thereof

| Row | column 1<br>A | column 2<br>B |
|---|---|---|
| 1 | 3021, 3297, 3573, 3849, 4125, 4401, 4677, 4953, 7437, 7713, 7989, 8265, 8541, 8817, 9093, 9369 | 5229, 5505, 5781, 6057, 6333, 6609, 6885, 7161 |

TABLE 4A-continued

Nucleic acid sequences encoding Zika virus prME protein (prME short) or a fragment or variant thereof

| Row | column 1 A | column 2 B |
|---|---|---|
| 2 | 3022, 3298, 3574, 3850, 4126, 4402, 4678, 4954, 7438, 7714, 7990, 8266, 8542, 8818, 9094, 9370 | 5230, 5506, 5782, 6058, 6334, 6610, 6886, 7162 |
| 3 | 3023, 3299, 3575, 3851, 4127, 4403, 4679, 4955, 7439, 7715, 7991, 8267, 8543, 8819, 9095, 9371 | 5231, 5507, 5783, 6059, 6335, 6611, 6887, 7163 |
| 4 | 3024, 3300, 3576, 3852, 4128, 4404, 4680, 4956, 7440, 7716, 7992, 8268, 8544, 8820, 9096, 9372 | 5232, 5508, 5784, 6060, 6336, 6612, 6888, 7164 |
| 5 | 3029, 3305, 3581, 3857, 4133, 4409, 4685, 4961, 7445, 7721, 7997, 8273, 8549, 8825, 9101, 9377 | 5237, 5513, 5789, 6065, 6341, 6617, 6893, 7169 |
| 6 | 3030, 3306, 3582, 3858, 4134, 4410, 4686, 4962, 7446, 7722, 7998, 8274, 8550, 8826, 9102, 9378 | 5238, 5514, 5790, 6066, 6342, 6618, 6894, 7170 |
| 7 | 3031, 3307, 3583, 3859, 4135, 4411, 4687, 4963, 7447, 7723, 7999, 8275, 8551, 8827, 9103, 9379 | 5239, 5515, 5791, 6067, 6343, 6619, 6895, 7171 |
| 8 | 3032, 3308, 3584, 3860, 4136, 4412, 4688, 4964, 7448, 7724, 8000, 8276, 8552, 8828, 9104, 9380 | 5240, 5516, 5792, 6068, 6344, 6620, 6896, 7172 |
| 9 | 3033, 3309, 3585, 3861, 4137, 4413, 4689, 4965, 7449, 7725, 8001, 8277, 8553, 8829, 9105, 9381 | 5241, 5517, 5793, 6069, 6345, 6621, 6897, 7173 |
| 10 | 3034, 3310, 3586, 3862, 4138, 4414, 4690, 4966, 7450, 7726, 8002, 8278, 8554, 8830, 9106, 9382 | 5242, 5518, 5794, 6070, 6346, 6622, 6898, 7174 |
| 11 | 3035, 3311, 3587, 3863, 4139, 4415, 4691, 4967, 7451, 7727, 8003, 8279, 8555, 8831, 9107, 9383 | 5243, 5519, 5795, 6071, 6347, 6623, 6899, 7175 |
| 12 | 3036, 3312, 3588, 3864, 4140, 4416, 4692, 4968, 7452, 7728, 8004, 8280, 8556, 8832, 9108, 9384 | 5244, 5520, 5796, 6072, 6348, 6624, 6900, 7176 |
| 13 | 3037, 3313, 3589, 3865, 4141, 4417, 4693, 4969, 7453, 7729, 8005, 8281, 8557, 8833, 9109, 9385 | 5245, 5521, 5797, 6073, 6349, 6625, 6901, 7177 |
| 14 | 3038, 3314, 3590, 3866, 4142, 4418, 4694, 4970, 7454, 7730, 8006, 8282, 8558, 8834, 9110, 9386 | 5246, 5522, 5798, 6074, 6350, 6626, 6902, 7178 |
| 15 | 3039, 3315, 3591, 3867, 4143, 4419, 4695, 4971, 7455, 7731, 8007, 8283, 8559, 8835, 9111, 9387 | 5247, 5523, 5799, 6075, 6351, 6627, 6903, 7179 |
| 16 | 3115, 3391, 3667, 3943, 4219, 4495, 4771, 5047, 7531, 7807, 8083, 8359, 8635, 8911, 9187, 9463 | 5323, 5599, 5875, 6151, 6427, 6703, 6979, 7255 |
| 17 | 3186, 3462, 3738, 4014, 4290, 4566, 4842, 5118, 7602, 7878, 8154, 8430, 8706, 8982, 9258, 9534 | 5394, 5670, 5946, 6222, 6498, 6774, 7050, 7326 |
| 18 | 3187, 3463, 3739, 4015, 4291, 4567, 4843, 5119, 7603, 7879, 8155, 8431, 8707, 8983, 9259, 9535 | 5395, 5671, 5947, 6223, 6499, 6775, 7051, 7327 |
| 19 | 3188, 3464, 3740, 4016, 4292, 4568, 4844, 5120, 7604, 7880, 8156, 8432, 8708, 8984, 9260, 9536 | 5396, 5672, 5948, 6224, 6500, 6776, 7052, 7328 |
| 20 | 3189, 3465, 3741, 4017, 4293, 4569, 4845, 5121, 7605, 7881, 8157, 8433, 8709, 8985, 9261, 9537 | 5397, 5673, 5949, 6225, 6501, 6777, 7053, 7329 |
| 21 | 3190, 3466, 3742, 4018, 4294, 4570, 4846, 5122, 7606, 7882, 8158, 8434, 8710, 8986, 9262, 9538 | 5398, 5674, 5950, 6226, 6502, 6778, 7054, 7330 |
| 22 | 3191, 3467, 3743, 4019, 4295, 4571, 4847, 5123, 7607, 7883, 8159, 8435, 8711, 8987, 9263, 9539 | 5399, 5675, 5951, 6227, 6503, 6779, 7055, 7331 |
| 23 | 3192, 3468, 3744, 4020, 4296, 4572, 4848, 5124, 7608, 7884, 8160, 8436, 8712, 8988, 9264, 9540 | 5400, 5676, 5952, 6228, 6504, 6780, 7056, 7332 |
| 24 | 3193, 3469, 3745, 4021, 4297, 4573, 4849, 5125, 7609, 7885, 8161, 8437, 8713, 8989, 9265, 9541 | 5401, 5677, 5953, 6229, 6505, 6781, 7057, 7333 |
| 25 | 3194, 3470, 3746, 4022, 4298, 4574, 4850, 5126, 7610, 7886, 8162, 8438, 8714, 8990, 9266, 9542 | 5402, 5678, 5954, 6230, 6506, 6782, 7058, 7334 |
| 26 | 3195, 3471, 3747, 4023, 4299, 4575, 4851, 5127, 7611, 7887, 8163, 8439, 8715, 8991, 9267, 9543 | 5403, 5679, 5955, 6231, 6507, 6783, 7059, 7335 |
| 27 | 3196, 3472, 3748, 4024, 4300, 4576, 4852, 5128, 7612, 7888, 8164, 8440, 8716, 8992, 9268, 9544 | 5404, 5680, 5956, 6232, 6508, 6784, 7060, 7336 |
| 28 | 3197, 3473, 3749, 4025, 4301, 4577, 4853, 5129, 7613, 7889, 8165, 8441, 8717, 8993, 9269, 9545 | 5405, 5681, 5957, 6233, 6509, 6785, 7061, 7337 |
| 29 | 3198, 3474, 3750, 4026, 4302, 4578, 4854, 5130, 7614, 7890, 8166, 8442, 8718, 8994, 9270, 9546 | 5406, 5682, 5958, 6234, 6510, 6786, 7062, 7338 |
| 30 | 3199, 3475, 3751, 4027, 4303, 4579, 4855, 5131, 7615, 7891, 8167, 8443, 8719, 8995, 9271, 9547 | 5407, 5683, 5959, 6235, 6511, 6787, 7063, 7339 |
| 31 | 3200, 3476, 3752, 4028, 4304, 4580, 4856, 5132, 7616, 7892, 8168, 8444, 8720, 8996, 9272, 9548 | 5408, 5684, 5960, 6236, 6512, 6788, 7064, 7340 |
| 32 | 3201, 3477, 3753, 4029, 4305, 4581, 4857, 5133, 7617, 7893, 8169, 8445, 8721, 8997, 9273, 9549 | 5409, 5685, 5961, 6237, 6513, 6789, 7065, 7341 |
| 33 | 3202, 3478, 3754, 4030, 4306, 4582, 4858, 5134, 7618, 7894, 8170, 8446, 8722, 8998, 9274, 9550 | 5410, 5686, 5962, 6238, 6514, 6790, 7066, 7342 |
| 34 | 3203, 3479, 3755, 4031, 4307, 4583, 4859, 5135, 7619, 7895, 8171, 8447, 8723, 8999, 9275, 9551 | 5411, 5687, 5963, 6239, 6515, 6791, 7067, 7343 |
| 35 | 3204, 3480, 3756, 4032, 4308, 4584, 4860, 5136, 7620, 7896, 8172, 8448, 8724, 9000, 9276, 9552 | 5412, 5688, 5964, 6240, 6516, 6792, 7068, 7344 |
| 36 | 3205, 3481, 3757, 4033, 4309, 4585, 4861, 5137, 7621, 7897, 8173, 8449, 8725, 9001, 9277, 9553 | 5413, 5689, 5965, 6241, 6517, 6793, 7069, 7345 |
| 37 | 3206, 3482, 3758, 4034, 4310, 4586, 4862, 5138, 7622, 7898, 8174, 8450, 8726, 9002, 9278, 9554 | 5414, 5690, 5966, 6242, 6518, 6794, 7070, 7346 |

TABLE 4A-continued

Nucleic acid sequences encoding Zika virus prME protein (prME short) or a fragment or variant thereof

| Row | column 1 A | column 2 B |
|---|---|---|
| 38 | 3207, 3483, 3759, 4035, 4311, 4587, 4863, 5139, 7623, 7899, 8175, 8451, 8727, 9003, 9279, 9555 | 5415, 5691, 5967, 6243, 6519, 6795, 7071, 7347 |
| 39 | 3208, 3484, 3760, 4036, 4312, 4588, 4864, 5140, 7624, 7900, 8176, 8452, 8728, 9004, 9280, 9556 | 5416, 5692, 5968, 6244, 6520, 6796, 7072, 7348 |
| 40 | 3209, 3485, 3761, 4037, 4313, 4589, 4865, 5141, 7625, 7901, 8177, 8453, 8729, 9005, 9281, 9557 | 5417, 5693, 5969, 6245, 6521, 6797, 7073, 7349 |
| 41 | 3210, 3486, 3762, 4038, 4314, 4590, 4866, 5142, 7626, 7902, 8178, 8454, 8730, 9006, 9282, 9558 | 5418, 5694, 5970, 6246, 6522, 6798, 7074, 7350 |
| 42 | 3211, 3487, 3763, 4039, 4315, 4591, 4867, 5143, 7627, 7903, 8179, 8455, 8731, 9007, 9283, 9559 | 5419, 5695, 5971, 6247, 6523, 6799, 7075, 7351 |
| 43 | 3212, 3488, 3764, 4040, 4316, 4592, 4868, 5144, 7628, 7904, 8180, 8456, 8732, 9008, 9284, 9560 | 5420, 5696, 5972, 6248, 6524, 6800, 7076, 7352 |
| 44 | 3213, 3489, 3765, 4041, 4317, 4593, 4869, 5145, 7629, 7905, 8181, 8457, 8733, 9009, 9285, 9561 | 5421, 5697, 5973, 6249, 6525, 6801, 7077, 7353 |
| 45 | 3214, 3490, 3766, 4042, 4318, 4594, 4870, 5146, 7630, 7906, 8182, 8458, 8734, 9010, 9286, 9562 | 5422, 5698, 5974, 6250, 6526, 6802, 7078, 7354 |
| 46 | 3215, 3491, 3767, 4043, 4319, 4595, 4871, 5147, 7631, 7907, 8183, 8459, 8735, 9011, 9287, 9563 | 5423, 5699, 5975, 6251, 6527, 6803, 7079, 7355 |
| 47 | 3216, 3492, 3768, 4044, 4320, 4596, 4872, 5148, 7632, 7908, 8184, 8460, 8736, 9012, 9288, 9564 | 5424, 5700, 5976, 6252, 6528, 6804, 7080, 7356 |
| 48 | 3217, 3493, 3769, 4045, 4321, 4597, 4873, 5149, 7633, 7909, 8185, 8461, 8737, 9013, 9289, 9565 | 5425, 5701, 5977, 6253, 6529, 6805, 7081, 7357 |
| 49 | 3218, 3494, 3770, 4046, 4322, 4598, 4874, 5150, 7634, 7910, 8186, 8462, 8738, 9014, 9290, 9566 | 5426, 5702, 5978, 6254, 6530, 6806, 7082, 7358 |
| 50 | 3219, 3495, 3771, 4047, 4323, 4599, 4875, 5151, 7635, 7911, 8187, 8463, 8739, 9015, 9291, 9567 | 5427, 5703, 5979, 6255, 6531, 6807, 7083, 7359 |
| 51 | 3220, 3496, 3772, 4048, 4324, 4600, 4876, 5152, 7636, 7912, 8188, 8464, 8740, 9016, 9292, 9568 | 5428, 5704, 5980, 6256, 6532, 6808, 7084, 7360 |
| 52 | 3221, 3497, 3773, 4049, 4325, 4601, 4877, 5153, 7637, 7913, 8189, 8465, 8741, 9017, 9293, 9569 | 5429, 5705, 5981, 6257, 6533, 6809, 7085, 7361 |
| 53 | 3222, 3498, 3774, 4050, 4326, 4602, 4878, 5154, 7638, 7914, 8190, 8466, 8742, 9018, 9294, 9570 | 5430, 5706, 5982, 6258, 6534, 6810, 7086, 7362 |
| 54 | 3223, 3499, 3775, 4051, 4327, 4603, 4879, 5155, 7639, 7915, 8191, 8467, 8743, 9019, 9295, 9571 | 5431, 5707, 5983, 6259, 6535, 6811, 7087, 7363 |
| 55 | 3224, 3500, 3776, 4052, 4328, 4604, 4880, 5156, 7640, 7916, 8192, 8468, 8744, 9020, 9296, 9572 | 5432, 5708, 5984, 6260, 6536, 6812, 7088, 7364 |
| 56 | 3225, 3501, 3777, 4053, 4329, 4605, 4881, 5157, 7641, 7917, 8193, 8469, 8745, 9021, 9297, 9573 | 5433, 5709, 5985, 6261, 6537, 6813, 7089, 7365 |
| 57 | 3226, 3502, 3778, 4054, 4330, 4606, 4882, 5158, 7642, 7918, 8194, 8470, 8746, 9022, 9298, 9574 | 5434, 5710, 5986, 6262, 6538, 6814, 7090, 7366 |
| 58 | 3227, 3503, 3779, 4055, 4331, 4607, 4883, 5159, 7643, 7919, 8195, 8471, 8747, 9023, 9299, 9575 | 5435, 5711, 5987, 6263, 6539, 6815, 7091, 7367 |
| 59 | 3228, 3504, 3780, 4056, 4332, 4608, 4884, 5160, 7644, 7920, 8196, 8472, 8748, 9024, 9300, 9576 | 5436, 5712, 5988, 6264, 6540, 6816, 7092, 7368 |
| 60 | 3229, 3505, 3781, 4057, 4333, 4609, 4885, 5161, 7645, 7921, 8197, 8473, 8749, 9025, 9301, 9577 | 5437, 5713, 5989, 6265, 6541, 6817, 7093, 7369 |
| 61 | 3230, 3506, 3782, 4058, 4334, 4610, 4886, 5162, 7646, 7922, 8198, 8474, 8750, 9026, 9302, 9578 | 5438, 5714, 5990, 6266, 6542, 6818, 7094, 7370 |
| 62 | 3231, 3507, 3783, 4059, 4335, 4611, 4887, 5163, 7647, 7923, 8199, 8475, 8751, 9027, 9303, 9579 | 5439, 5715, 5991, 6267, 6543, 6819, 7095, 7371 |
| 63 | 3232, 3508, 3784, 4060, 4336, 4612, 4888, 5164, 7648, 7924, 8200, 8476, 8752, 9028, 9304, 9580 | 5440, 5716, 5992, 6268, 6544, 6820, 7096, 7372 |
| 64 | 3233, 3509, 3785, 4061, 4337, 4613, 4889, 5165, 7649, 7925, 8201, 8477, 8753, 9029, 9305, 9581 | 5441, 5717, 5993, 6269, 6545, 6821, 7097, 7373 |
| 65 | 3234, 3510, 3786, 4062, 4338, 4614, 4890, 5166, 7650, 7926, 8202, 8478, 8754, 9030, 9306, 9582 | 5442, 5718, 5994, 6270, 6546, 6822, 7098, 7374 |
| 66 | 3235, 3511, 3787, 4063, 4339, 4615, 4891, 5167, 7651, 7927, 8203, 8479, 8755, 9031, 9307, 9583 | 5443, 5719, 5995, 6271, 6547, 6823, 7099, 7375 |
| 67 | 3236, 3512, 3788, 4064, 4340, 4616, 4892, 5168, 7652, 7928, 8204, 8480, 8756, 9032, 9308, 9584 | 5444, 5720, 5996, 6272, 6548, 6824, 7100, 7376 |
| 68 | 3237, 3513, 3789, 4065, 4341, 4617, 4893, 5169, 7653, 7929, 8205, 8481, 8757, 9033, 9309, 9585 | 5445, 5721, 5997, 6273, 6549, 6825, 7101, 7377 |
| 69 | 3238, 3514, 3790, 4066, 4342, 4618, 4894, 5170, 7654, 7930, 8206, 8482, 8758, 9034, 9310, 9586 | 5446, 5722, 5998, 6274, 6550, 6826, 7102, 7378 |
| 70 | 3239, 3515, 3791, 4067, 4343, 4619, 4895, 5171, 7655, 7931, 8207, 8483, 8759, 9035, 9311, 9587 | 5447, 5723, 5999, 6275, 6551, 6827, 7103, 7379 |
| 71 | 3240, 3516, 3792, 4068, 4344, 4620, 4896, 5172, 7656, 7932, 8208, 8484, 8760, 9036, 9312, 9588 | 5448, 5724, 6000, 6276, 6552, 6828, 7104, 7380 |
| 72 | 3241, 3517, 3793, 4069, 4345, 4621, 4897, 5173, 7657, 7933, 8209, 8485, 8761, 9037, 9313, 9589 | 5449, 5725, 6001, 6277, 6553, 6829, 7105, 7381 |
| 73 | 3242, 3518, 3794, 4070, 4346, 4622, 4898, 5174, 7658, 7934, 8210, 8486, 8762, 9038, 9314, 9590 | 5450, 5726, 6002, 6278, 6554, 6830, 7106, 7382 |

TABLE 4A-continued

Nucleic acid sequences encoding Zika virus prME protein (prME short) or a fragment or variant thereof

| Row | column 1 A | column 2 B |
|---|---|---|
| 74 | 3243, 3519, 3795, 4071, 4347, 4623, 4899, 5175, 7659, 7935, 8211, 8487, 8763, 9039, 9315, 9591 | 5451, 5727, 6003, 6279, 6555, 6831, 7107, 7383 |
| 75 | 3244, 3520, 3796, 4072, 4348, 4624, 4900, 5176, 7660, 7936, 8212, 8488, 8764, 9040, 9316, 9592 | 5452, 5728, 6004, 6280, 6556, 6832, 7108, 7384 |
| 76 | 3245, 3521, 3797, 4073, 4349, 4625, 4901, 5177, 7661, 7937, 8213, 8489, 8765, 9041, 9317, 9593 | 5453, 5729, 6005, 6281, 6557, 6833, 7109, 7385 |
| 77 | 3246, 3522, 3798, 4074, 4350, 4626, 4902, 5178, 7662, 7838, 8214, 8490, 8766, 9042, 9318, 9594 | 5454, 5730, 6006, 6282, 6558, 6834, 7110, 7386 |
| 78 | 3247, 3523, 3799, 4075, 4351, 4627, 4903, 5179, 7663, 7939, 8215, 8491, 8767, 9043, 9319, 9595 | 5455, 5731, 6007, 6283, 6559, 6835, 7111, 7387 |
| 79 | 3248, 3524, 3800, 4076, 4352, 4628, 4904, 5180, 7664, 7940, 8216, 8492, 8768, 9044, 9320, 9596 | 5456, 5732, 6008, 6284, 6560, 6836, 7112, 7388 |
| 80 | 3249, 3525, 3801, 4077, 4353, 4629, 4905, 5181, 7665, 7941, 8217, 8493, 8769, 9045, 9321, 9597 | 5457, 5733, 6009, 6285, 6561, 6837, 7113, 7389 |
| 81 | 10001, 10041, 10081, 10121, 10161, 10201, 10241, 10281, 10641, 10681, 10721, 10761, 10801, 10841, 10881, 10921 | 10321, 10361, 10401, 10441, 10481, 10521, 10561, 10601 |
| 82 | 10002, 10042, 10082, 10122, 10162, 10202, 10242, 10282, 10642, 10682, 10722, 10762, 10802, 10842, 10882, 10922 | 10322, 10362, 10402, 10442, 10482, 10522, 10562, 10602 |
| 83 | 10003, 10043, 10083, 10123, 10163, 10203, 10243, 10283, 10643, 10683, 10723, 10763, 10803, 10843, 10883, 10923 | 10323, 10363, 10403, 10443, 10483, 10523, 10563, 10603 |
| 84 | 10004, 10044, 10084, 10124, 10164, 10204, 10244, 10284, 10644, 10684, 10724, 10764, 10804, 10844, 10884, 10924 | 10324, 10364, 10404, 10444, 10484, 10524, 10564, 10604 |
| 85 | 10005, 10045, 10085, 10125, 10165, 10205, 10245, 10285, 10645, 10685, 10725, 10765, 10805, 10845, 10885, 10925 | 10325, 10365, 10405, 10445, 10485, 10525, 10565, 10605 |
| 86 | 10006, 10046, 10086, 10126, 10166, 10206, 10246, 10286, 10646, 10686, 10726, 10766, 10806, 10846, 10886, 10926 | 10326, 10366, 10406, 10446, 10486, 10526, 10566, 10606 |
| 87 | 10007, 10047, 10087, 10127, 10167, 10207, 10247, 10287, 10647, 10687, 10727, 10767, 10807, 10847, 10887, 10927 | 10327, 10367, 10407, 10447, 10487, 10527, 10567, 10607 |
| 88 | 10008, 10048, 10088, 10128, 10168, 10208, 10248, 10288, 10648, 10688, 10728, 10768, 10808, 10848, 10888, 10928 | 10328, 10368, 10408, 10448, 10488, 10528, 10568, 10608 |
| 89 | 10009, 10049, 10089, 10129, 10169, 10209, 10249, 10289, 10649, 10689, 10729, 10769, 10809, 10849, 10889, 10929 | 10329, 10369, 10409, 10449, 10489, 10529, 10569, 10609 |
| 90 | 10010, 10050, 10090, 10130, 10170, 10210, 10250, 10290, 10650, 10690, 10730, 10770, 10810, 10850, 10890, 10930 | 10330, 10370, 10410, 10450, 10490, 10530, 10570, 10610 |
| 91 | 10011, 10051, 10091, 10131, 10171, 10211, 10251, 10291, 10651, 10691, 10731, 10771, 10811, 10851, 10891, 10931 | 10331, 10371, 10411, 10451, 10491, 10531, 10571, 10611 |
| 92 | 10012, 10052, 10092, 10132, 10172, 10212, 10252, 10292, 10652, 10692, 10732, 10772, 10812, 10852, 10892, 10932 | 10332, 10372, 10412, 10452, 10492, 10532, 10572, 10612 |
| 93 | 10013, 10053, 10093, 10133, 10173, 10213, 10253, 10293, 10653, 10693, 10733, 10773, 10813, 10853, 10893, 10933 | 10333, 10373, 10413, 10453, 10493, 10533, 10573, 10613 |
| 94 | 10014, 10054, 10094, 10134, 10174, 10214, 10254, 10294, 10654, 10694, 10734, 10774, 10814, 10854, 10894, 10934 | 10334, 10374, 10414, 10454, 10494, 10534, 10574, 10614 |
| 95 | 10015, 10055, 10095, 10135, 10175, 10215, 10255, 10295, 10655, 10695, 10735, 10775, 10815, 10855, 10895, 10935 | 10335, 10375, 10415, 10455, 10495, 10535, 10575, 10615 |
| 96 | 10016, 10056, 10096, 10136, 10176, 10216, 10256, 10296, 10656, 10696, 10736, 10776, 10816, 10856, 10896, 10936 | 10336, 10376, 10416, 10456, 10496, 10536, 10576, 10616 |
| 97 | 10017, 10057, 10097, 10137, 10177, 10217, 10257, 10297, 10657, 10697, 10737, 10777, 10817, 10857, 10897, 10937 | 10337, 10377, 10417, 10457, 10497, 10537, 10577, 10617 |
| 98 | 10018, 10058, 10098, 10138, 10178, 10218, 10258, 10298, 10658, 10698, 10738, 10778, 10818, 10858, 10898, 10938 | 10338, 10378, 10418, 10458, 10498, 10538, 10578, 10618 |
| 99 | 10019, 10059, 10099, 10139, 10179, 10219, 10259, 10299, 10659, 10699, 10739, 10779, 10819, 10859, 10899, 10939 | 10339, 10379, 10419, 10459, 10499, 10539, 10579, 10619 |

TABLE 4A-continued

Nucleic acid sequences encoding Zika virus prME protein (prME short) or a fragment or variant thereof

| Row | column 1 A | column 2 B |
|---|---|---|
| 100 | 10020, 10090, 10100, 10140, 10180, 10220, 10260, 10300, 10660, 10700, 10740, 10780, 10820, 10860, 10900, 10940 | 10340, 10380, 10420, 10460, 10500, 10540, 10580, 10620 |
| 101 | 10021, 10061, 10101, 10141, 10181, 10221, 10261, 10301, 10661, 10701, 10741, 10781, 10821, 10861, 10901, 10941 | 10341, 10381, 10421, 10461, 10501, 10541, 10581, 10621 |
| 102 | 10022, 10062, 10102, 10142, 10182, 10222, 10262, 10302, 10662, 10702, 10742, 10782, 10822, 10862, 10902, 10942 | 10342, 10382, 10422, 10462, 10502, 10542, 10582, 10622 |
| 103 | 10023, 10063, 10103, 10143, 10183, 10223, 10263, 10303, 10663, 10703, 10743, 10783, 10823, 10863, 10903, 10943 | 10343, 10383, 10423, 10463, 10503, 10543, 10583, 10623 |
| 104 | 10024, 10064, 10104, 10144, 10184, 10224, 10264, 10304, 10664, 10704, 10744, 10784, 10824, 10864, 10904, 10944 | 10344, 10384, 10424, 10464, 10504, 10544, 10584, 10624 |
| 105 | 11184, 11208, 11232, 11256, 11280, 11304, 11328, 11352, 11568, 11592, 11616, 11640, 11664, 11688, 11712, 11736 | 11376, 11400, 11424, 11448, 11472, 11496, 11520, 11544 |
| 106 | 11185, 11209, 11233, 11257, 11281, 11305, 11329, 11353, 11569, 11593, 11617, 11641, 11665, 11689, 11713, 11737 | 11377, 11401, 11425, 11449, 11473, 11497, 11521, 11545 |
| 107 | 11186, 11210, 11234, 11258, 11282, 11306, 11330, 11354, 11570, 11594, 11618, 11642, 11666, 11690, 11714, 11738 | 11378, 11402, 11426, 11450, 11474, 11498, 11522, 11546 |
| 108 | 11187, 11211, 11235, 11259, 11283, 11307, 11331, 11355, 11571, 11595, 11619, 11643, 11667, 11691, 11715, 11739 | 11379, 11403, 11427, 11451, 11475, 11499, 11523, 11547 |
| 109 | 11188, 11212, 11236, 11260, 11284, 11308, 11332, 11356, 11572, 11596, 11620, 11644, 11668, 11692, 11716, 11740 | 11380, 11404, 11428, 11452, 11476, 11500, 11524, 11548 |
| 110 | 11189, 11213, 11237, 11261, 11285, 11309, 11333, 11357, 11573, 11597, 11621, 11645, 11669, 11693, 11717, 11741 | 11381, 11405, 11429, 11453, 11477, 11501, 11525, 11549 |
| 111 | 11190, 11214, 11238, 11262, 11286, 11310, 11334, 11358, 11574, 11598, 11622, 11646, 11670, 11694, 11718, 11742 | 11382, 11406, 11430, 11454, 11478, 11502, 11526, 11550 |
| 112 | 11191, 11215, 11239, 11263, 11287, 11311, 11335, 11359, 11575, 11599, 11623, 11647, 11671, 11695, 11719, 11743 | 11383, 11407, 11431, 11455, 11479, 11503, 11527, 11551 |
| 113 | 11192, 11216, 11240, 11264, 11288, 11312, 11336, 11360, 11576, 11600, 11624, 11648, 11672, 11696, 11720, 11744 | 11384, 11408, 11432, 11456, 11480, 11504, 11528, 11552 |
| 114 | 11193, 11217, 11241, 11265, 11289, 11313, 11337, 11361, 11577, 11601, 11625, 11649, 11673, 11697, 11721, 11745 | 11385, 11409, 11433, 11457, 11481, 11505, 11529, 11553 |
| 115 | 11194, 11218, 11242, 11266, 11290, 11314, 11338, 11362, 11578, 11602, 11626, 11650, 11674, 11698, 11722, 11746 | 11386, 11410, 11434, 11458, 11482, 11506, 11530, 11554 |
| 116 | 11195, 11219, 11243, 11267, 11291, 11315, 11339, 11363, 11579, 11603, 11627, 11651, 11675, 11699, 11723, 11747 | 11387, 11411, 11435, 11459, 11483, 11507, 11531, 11555 |
| 117 | 11196, 11220, 11244, 11268, 11292, 11316, 11340, 11364, 11580, 11604, 11628, 11652, 11676, 11700, 11724, 11748 | 11388, 11412, 11436, 11460, 11484, 11508, 11532, 11556 |
| 118 | 11197, 11221, 11245, 11269, 11293, 11317, 11341, 11365, 11581, 11605, 11629, 11653, 11677, 11701, 11725, 11749 | 11389, 11413, 11437, 11461, 11485, 11509, 11533, 11557 |
| 119 | 11198, 11222, 11246, 11270, 11294, 11318, 11342, 11366, 11582, 11606, 11630, 11654, 11678, 11702, 11726, 11750 | 11390, 11414, 11438, 11462, 11486, 11510, 11534, 11558 |
| 120 | 11199, 11223, 11247, 11271, 11295, 11319, 11343, 11367, 11583, 11607, 11631, 11655, 11679, 11703, 11727, 11751 | 11391, 11415, 11439, 11463, 11487, 11511, 11535, 11559 |

In a particularly preferred embodiment, the at least one polypeptide encoded by the at least one coding region of the inventive artificial nucleic acid comprises or consists of Zika virus protein, preferably prME protein, or a fragment or variant thereof, wherein the at least one coding region comprises or consists of a nucleic acid sequence as defined by any one of the nucleic acid sequences in the first column ("A") in Table 5A (SEQ ID NO: 3041-3114, 3116-3119, 3317-3390, 3392-3395, 3593-3666, 3668-3671, 3869-3942, 3944-3947, 4145-4218, 4220-4223, 4421-4494, 4496-4499, 4697-4770, 4772-4775, 4973-5046, 5048-5051, 7457-7530, 7532-7535, 7733-7806, 7808-7811, 8009-8082, 8084-8087, 8285-8358, 8360-8363, 8561-8634, 8636-8639, 8837-8910, 8912-8915, 9113-9186, 9188-9191, 9389-9462, or 9464-9467), or as defined by any one of the nucleic acid sequences in the second column ("B") in Table 5A (5249-5322, 5324-5327, 5525-5598, 5600-5603, 5801-5874, 5876-5879, 6077-6150, 6152-6155, 6353-6426, 6428-6431, 6629-6702, 6704-6707, 6905-6978, 6980-6983, 7181-7254, or 7256-7259) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 5A (SEQ ID NO: 3041-3114, 3116-3119, 3317-3390, 3392-3395, 3593-3666, 3668-3671, 3869-3942, 3944-3947, 4145-4218, 4220-4223, 4421-4494, 4496-4499, 4697-4770, 4772-4775, 4973-5046, 5048-5051, 7457-7530, 7532-7535, 7733-7806, 7808-7811, 8009-8082, 8084-8087, 8285-8358, 8360-8363, 8561-8634, 8636-8639, 8837-8910, 8912-8915, 9113-9186, 9188-9191, 9389-9462, or 9464-9467), or as defined by any one of the nucleic acid sequences in the second column ("B") in Table 5A (5249-5322, 5324-5327, 5525-5598, 5600-5603, 5801-5874, 5876-5879, 6077-6150, 6152-6155, 6353-6426, 6428-6431, 6629-6702, 6704-6707, 6905-6978, 6980-6983, 7181-7254, or 7256-7259) or a fragment or variant of any one of these sequences.

More preferably, the at least one polypeptide encoded by the at least one coding region of the inventive artificial nucleic acid comprises or consists of Zika virus protein, preferably prME protein, or a fragment or variant thereof, wherein the at least one coding region comprises or consists of a modified nucleic acid sequence as defined by any one of the nucleic acid sequences in the first column ("A") in Table 5A (3317-3390, 3392-3395, 3593-3666, 3668-3671, 3869-3942, 3944-3947, 4145-4218, 4220-4223, 4421-4494, 4496-4499, 4697-4770, 4772-4775, 4973-5046, 5048-5051, 7733-7806, 7808-7811, 8009-8082, 8084-8087, 8285-8358, 8360-8363, 8561-8634, 8636-8639, 8837-8910, 8912-8915, 9113-9186, 9188-9191, 9389-9462, or 9464-9467), or as defined by any one of the nucleic acid sequences in the second column ("B") in Table 5A (5525-5598, 5600-5603, 5801-5874, 5876-5879, 6077-6150, 6152-6155, 6353-6426, 6428-6431, 6629-6702, 6704-6707, 6905-6978, 6980-6983, 7181-7254, or 7256-7259) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 5A (3317-3390, 3392-3395, 3593-3666, 3668-3671, 3869-3942, 3944-3947, 4145-4218, 4220-4223, 4421-4494, 4496-4499, 4697-4770, 4772-4775, 4973-5046, 5048-5051, 7733-7806, 7808-7811, 8009-8082, 8084-8087, 8285-8358, 8360-8363, 8561-8634, 8636-8639, 8837-8910, 8912-8915, 9113-9186, 9188-9191, 9389-9462, or 9464-9467), or as defined by any one of the nucleic acid sequences in the second column ("B") in Table 5A (5525-5598, 5600-5603, 5801-5874, 5876-5879, 6077-6150, 6152-6155, 6353-6426, 6428-6431, 6629-6702, 6704-6707, 6905-6978, 6980-6983, 7181-7254, or 7256-7259) or a fragment or variant of any one of these sequences.

TABLE 5A

Nucleic acid sequences encoding Zika virus prME protein (prME short/HT) or a fragment or variant thereof

| Row | column 1 A | column 2 B |
|---|---|---|
| 1 | 3041, 3317, 3593, 3869, 4145, 4421, 4697, 4973, 7457, 7733, 8009, 8285, 8561, 8837, 9113, 9389 | 5249, 5525, 5801, 6077, 6353, 6629, 6905, 7181 |
| 2 | 3042, 3318, 3594, 3870, 4146, 4422, 4698, 4974, 7458, 7734, 8010, 8286, 8562, 8838, 9114, 9390 | 5250, 5526, 5802, 6078, 6354, 6630, 6906, 7182 |
| 3 | 3043, 3319, 3595, 3871, 4147, 4423, 4699, 4975, 7459, 7735, 8011, 8287, 8563, 8839, 9115, 9391 | 5251, 5527, 5803, 6079, 6355, 6631, 6907, 7183 |
| 4 | 3044, 3320, 3596, 3872, 4148, 4424, 4700, 4976, 7460, 7736, 8012, 8288, 8564, 8840, 9116, 9392 | 5252, 5528, 5804, 6080, 6356, 6632, 6908, 7184 |
| 5 | 3045, 3321, 3597, 3873, 4149, 4425, 4701, 4977, 7461, 7737, 8013, 8289, 8565, 8841, 9117, 9393 | 5253, 5529, 5805, 6081, 6357, 6633, 6909, 7185 |
| 6 | 3046, 3322, 3598, 3874, 4150, 4426, 4702, 4978, 7462, 7738, 8014, 8290, 8566, 8842, 9118, 9394 | 5254, 5530, 5806, 6082, 6358, 6634, 6910, 7186 |
| 7 | 3047, 3323, 3599, 3875, 4151, 4427, 4703, 4979, 7463, 7739, 8015, 8291, 8567, 8843, 9119, 9395 | 5255, 5531, 5807, 6083, 6359, 6635, 6911, 7187 |
| 8 | 3048, 3324, 3600, 3876, 4152, 4428, 4704, 4980, 7464, 7740, 8016, 8292, 8568, 8844, 9120, 9396 | 5256, 5532, 5808, 6084, 6360, 6636, 6912, 7188 |
| 9 | 3049, 3325, 3601, 3877, 4153, 4429, 4705, 4981, 7465, 7741, 8017, 8293, 8569, 8845, 9121, 9397 | 5257, 5533, 5809, 6085, 6361, 6637, 6913, 7189 |
| 10 | 3050, 3326, 3602, 3878, 4154, 4430, 4706, 4982, 7466, 7742, 8018, 8294, 8570, 8846, 9122, 9398 | 5258, 5534, 5810, 6086, 6362, 6638, 6914, 7190 |
| 11 | 3051, 3327, 3603, 3879, 4155, 4431, 4707, 4983, 7467, 7743, 8019, 8295, 8571, 8847, 9123, 9399 | 5259, 5535, 5811, 6087, 6363, 6639, 6915, 7191 |
| 12 | 3052, 3328, 3604, 3880, 4156, 4432, 4708, 4984, 7468, 7744, 8020, 8296, 8572, 8848, 9124, 9400 | 5260, 5536, 5812, 6088, 6364, 6640, 6916, 7192 |
| 13 | 3053, 3329, 3605, 3881, 4157, 4433, 4709, 4985, 7469, 7745, 8021, 8297, 8573, 8849, 9125, 9401 | 5261, 5537, 5813, 6089, 6365, 6641, 6917, 7193 |
| 14 | 3054, 3330, 3606, 3882, 4158, 4434, 4710, 4986, 7470, 7746, 8022, 8298, 8574, 8850, 9126, 9402 | 5262, 5538, 5814, 6090, 6366, 6642, 6918, 7194 |
| 15 | 3055, 3331, 3607, 3883, 4159, 4435, 4711, 4987, 7471, 7747, 8023, 8299, 8575, 8851, 9127, 9403 | 5263, 5539, 5815, 6091, 6367, 6643, 6919, 7195 |
| 16 | 3056, 3332, 3608, 3884, 4160, 4436, 4712, 4988, 7472, 7748, 8024, 8300, 8576, 8852, 9128, 9404 | 5264, 5540, 5816, 6092, 6368, 6644, 6920, 7196 |
| 17 | 3057, 3333, 3609, 3885, 4161, 4437, 4713, 4989, 7473, 7749, 8025, 8301, 8577, 8853, 9129, 9405 | 5265, 5541, 5817, 6093, 6369, 6645, 6921, 7197 |
| 18 | 3058, 3334, 3610, 3886, 4162, 4438, 4714, 4990, 7474, 7750, 8026, 8302, 8578, 8854, 9130, 9406 | 5266, 5542, 5818, 6094, 6370, 6646, 6922, 7198 |

TABLE 5A-continued

Nucleic acid sequences encoding Zika virus prME protein (prME short/HT) or a fragment or variant thereof

| Row | column 1<br>A | column 2<br>B |
|---|---|---|
| 19 | 3059, 3335, 3611, 3887, 4163, 4439, 4715, 4991, 7475, 7751, 8027, 8303, 8579, 8855, 9131, 9407 | 5267, 5543, 5819, 6095, 6371, 6647, 6923, 7199 |
| 20 | 3060, 3336, 3612, 3888, 4164, 4440, 4716, 4992, 7476, 7752, 8028, 8304, 8580, 8856, 9132, 9408 | 5268, 5544, 5820, 6096, 6372, 6648, 6924, 7200 |
| 21 | 3061, 3337, 3613, 3889, 4165, 4441, 4717, 4993, 7477, 7753, 8029, 8305, 8581, 8857, 9133, 9409 | 5269, 5545, 5821, 6097, 6373, 6649, 6925, 7201 |
| 22 | 3062, 3338, 3614, 3890, 4166, 4442, 4718, 4994, 7478, 7754, 8030, 8306, 8582, 8858, 9134, 9410 | 5270, 5546, 5822, 6098, 6374, 6650, 6926, 7202 |
| 23 | 3063, 3339, 3615, 3891, 4167, 4443, 4719, 4995, 7479, 7755, 8031, 8307, 8583, 8859, 9135, 9411 | 5271, 5547, 5823, 6099, 6375, 6651, 6927, 7203 |
| 24 | 3064, 3340, 3616, 3892, 4168, 4444, 4720, 4996, 7480, 7756, 8032, 8308, 8584, 8860, 9136, 9412 | 5272, 5548, 5824, 6100, 6376, 6652, 6928, 7204 |
| 25 | 3065, 3341, 3617, 3893, 4169, 4445, 4721, 4997, 7481, 7757, 8033, 8309, 8585, 8861, 9137, 9413 | 5273, 5549, 5825, 6101, 6377, 6653, 6929, 7205 |
| 26 | 3066, 3342, 3618, 3894, 4170, 4446, 4722, 4998, 7482, 7758, 8034, 8310, 8586, 8862, 9138, 9414 | 5274, 5550, 5826, 6102, 6378, 6654, 6930, 7206 |
| 27 | 3067, 3343, 3619, 3895, 4171, 4447, 4723, 4999, 7483, 7759, 8035, 8311, 8587, 8863, 9139, 9415 | 5275, 5551, 5827, 6103, 6379, 6655, 6931, 7207 |
| 28 | 3068, 3344, 3620, 3896, 4172, 4448, 4724, 5000, 7484, 7760, 8036, 8312, 8588, 8864, 9140, 9416 | 5276, 5552, 5828, 6104, 6380, 6656, 6932, 7208 |
| 29 | 3069, 3345, 3621, 3897, 4173, 4449, 4725, 5001, 7485, 7761, 8037, 8313, 8589, 8865, 9141, 9417 | 5277, 5553, 5829, 6105, 6381, 6657, 6933, 7209 |
| 30 | 3070, 3346, 3622, 3898, 4174, 4450, 4726, 5002, 7486, 7762, 8038, 8314, 8590, 8866, 9142, 9418 | 5278, 5554, 5830, 6106, 6382, 6658, 6934, 7210 |
| 31 | 3071, 3347, 3623, 3899, 4175, 4451, 4727, 5003, 7487, 7763, 8039, 8315, 8591, 8867, 9143, 9419 | 5279, 5555, 5831, 6107, 6383, 6659, 6935, 7211 |
| 32 | 3072, 3348, 3624, 3900, 4176, 4452, 4728, 5004, 7488, 7764, 8040, 8316, 8592, 8868, 9144, 9420 | 5280, 5556, 5832, 6108, 6384, 6660, 6936, 7212 |
| 33 | 3073, 3349, 3625, 3901, 4177, 4453, 4729, 5005, 7489, 7765, 8041, 8317, 8593, 8869, 9145, 9421 | 5281, 5557, 5833, 6109, 6385, 6661, 6937, 7213 |
| 34 | 3074, 3350, 3626, 3902, 4178, 4454, 4730, 5006, 7490, 7766, 8042, 8318, 8594, 8870, 9146, 9422 | 5282, 5558, 5834, 6110, 6386, 6662, 6938, 7214 |
| 35 | 3075, 3351, 3627, 3903, 4179, 4455, 4731, 5007, 7491, 7767, 8043, 8319, 8595, 8871, 9147, 9423 | 5283, 5559, 5835, 6111, 6387, 6663, 6939, 7215 |
| 36 | 3076, 3352, 3628, 3904, 4180, 4456, 4732, 5008, 7492, 7768, 8044, 8320, 8596, 8872, 9148, 9424 | 5284, 5560, 5836, 6112, 6388, 6664, 6940, 7216 |
| 37 | 3077, 3353, 3629, 3905, 4181, 4457, 4733, 5009, 7493, 7769, 8045, 8321, 8597, 8873, 9149, 9425 | 5285, 5561, 5837, 6113, 6389, 6665, 6941, 7217 |
| 38 | 3078, 3354, 3630, 3906, 4182, 4458, 4734, 5010, 7494, 7770, 8046, 8322, 8598, 8874, 9150, 9426 | 5286, 5562, 5838, 6114, 6390, 6666, 6942, 7218 |
| 39 | 3079, 3355, 3631, 3907, 4183, 4459, 4735, 5011, 7495, 7771, 8047, 8323, 8599, 8875, 9151, 9427 | 5287, 5563, 5839, 6115, 6391, 6667, 6943, 7219 |
| 40 | 3080, 3356, 3632, 3908, 4184, 4460, 4736, 5012, 7496, 7772, 8048, 8324, 8600, 8876, 9152, 9428 | 5288, 5564, 5840, 6116, 6392, 6668, 6944, 7220 |
| 41 | 3081, 3357, 3633, 3909, 4185, 4461, 4737, 5013, 7497, 7773, 8049, 8325, 8601, 8877, 9153, 9429 | 5289, 5565, 5841, 6117, 6393, 6669, 6945, 7221 |
| 42 | 3082, 3358, 3634, 3910, 4186, 4462, 4738, 5014, 7498, 7774, 8050, 8326, 8602, 8878, 9154, 9430 | 5290, 5566, 5842, 6118, 6394, 6670, 6946, 7222 |
| 43 | 3083, 3359, 3635, 3911, 4187, 4463, 4739, 5015, 7499, 7775, 8051, 8327, 8603, 8879, 9155, 9431 | 5291, 5567, 5843, 6119, 6395, 6671, 6947, 7223 |
| 44 | 3084, 3360, 3636, 3912, 4188, 4464, 4740, 5016, 7500, 7776, 8052, 8328, 8604, 8880, 9156, 9432 | 5292, 5568, 5844, 6120, 6396, 6672, 6948, 7224 |
| 45 | 3085, 3361, 3637, 3913, 4189, 4465, 4741, 5017, 7501, 7777, 8053, 8329, 8605, 8881, 9157, 9433 | 5293, 5569, 5845, 6121, 6397, 6673, 6949, 7225 |
| 46 | 3086, 3362, 3638, 3914, 4190, 4466, 4742, 5018, 7502, 7778, 8054, 8330, 8606, 8882, 9158, 9434 | 5294, 5570, 5846, 6122, 6398, 6674, 6950, 7226 |
| 47 | 3087, 3363, 3639, 3915, 4191, 4467, 4743, 5019, 7503, 7779, 8055, 8331, 8607, 8883, 9159, 9435 | 5295, 5571, 5847, 6123, 6399, 6675, 6951, 7227 |
| 48 | 3088, 3364, 3640, 3916, 4192, 4468, 4744, 5020, 7504, 7780, 8056, 8332, 8608, 8884, 9160, 9436 | 5296, 5572, 5848, 6124, 6400, 6676, 6952, 7228 |
| 49 | 3089, 3365, 3641, 3917, 4193, 4469, 4745, 5021, 7505, 7781, 8057, 8333, 8609, 8885, 9161, 9437 | 5297, 5573, 5849, 6125, 6401, 6677, 6953, 7229 |
| 50 | 3090, 3366, 3642, 3918, 4194, 4470, 4746, 5022, 7506, 7782, 8058, 8334, 8610, 8886, 9162, 9438 | 5298, 5574, 5850, 6126, 6402, 6678, 6954, 7230 |
| 51 | 3091, 3367, 3643, 3919, 4195, 4471, 4747, 5023, 7507, 7783, 8059, 8335, 8611, 8887, 9163, 9439 | 5299, 5575, 5851, 6127, 6403, 6679, 6955, 7231 |
| 52 | 3092, 3368, 3644, 3920, 4196, 4472, 4748, 5024, 7508, 7784, 8060, 8336, 8612, 8888, 9164, 9440 | 5300, 5576, 5852, 6128, 6404, 6680, 6956, 7232 |
| 53 | 3093, 3369, 3645, 3921, 4197, 4473, 4749, 5025, 7509, 7785, 8061, 8337, 8613, 8889, 9165, 9441 | 5301, 5577, 5853, 6129, 6405, 6681, 6957, 7233 |
| 54 | 3094, 3370, 3646, 3922, 4198, 4474, 4750, 5026, 7510, 7786, 8062, 8338, 8614, 8890, 9166, 9442 | 5302, 5578, 5854, 6130, 6406, 6682, 6958, 7234 |
| 55 | 3095, 3371, 3647, 3923, 4199, 4475, 4751, 5027, 7511, 7787, 8063, 8339, 8615, 8891, 9167, 9443 | 5303, 5579, 5855, 6131, 6407, 6683, 6959, 7235 |

TABLE 5A-continued

Nucleic acid sequences encoding Zika virus prME protein (prME short/HT) or a fragment or variant thereof

| Row | column 1<br>A | column 2<br>B |
|---|---|---|
| 56 | 3096, 3372, 3648, 3924, 4200, 4476, 4752, 5028, 7512, 7788, 8064, 8340, 8616, 8892, 9168, 9444 | 5304, 5580, 5856, 6132, 6408, 6684, 6960, 7236 |
| 57 | 3097, 3373, 3649, 3925, 4201, 4477, 4753, 5029, 7513, 7789, 8065, 8341, 8617, 8893, 9169, 9445 | 5305, 5581, 5857, 6133, 6409, 6685, 6961, 7237 |
| 58 | 3098, 3374, 3650, 3926, 4202, 4478, 4754, 5030, 7514, 7790, 8066, 8342, 8618, 8894, 9170, 9446 | 5306, 5582, 5858, 6134, 6410, 6686, 6962, 7238 |
| 59 | 3099, 3375, 3651, 3927, 4203, 4479, 4755, 5031, 7515, 7791, 8067, 8343, 8619, 8895, 9171, 9447 | 5307, 5583, 5859, 6135, 6411, 6687, 6963, 7239 |
| 60 | 3100, 3376, 3652, 3928, 4204, 4480, 4756, 5032, 7516, 7792, 8068, 8344, 8620, 8896, 9172, 9448 | 5308, 5584, 5860, 6136, 6412, 6688, 6964, 7240 |
| 61 | 3101, 3377, 3653, 3929, 4205, 4481, 4757, 5033, 7517, 7793, 8069, 8345, 8621, 8897, 9173, 9449 | 5309, 5585, 5861, 6137, 6413, 6689, 6965, 7241 |
| 62 | 3102, 3378, 3654, 3930, 4206, 4482, 4758, 5034, 7518, 7794, 8070, 8346, 8622, 8898, 9174, 9450 | 5310, 5586, 5862, 6138, 6414, 6690, 6966, 7242 |
| 63 | 3103, 3379, 3655, 3931, 4207, 4483, 4759, 5035, 7519, 7795, 8071, 8347, 8623, 8899, 9175, 9451 | 5311, 5587, 5863, 6139, 6415, 6691, 6967, 7243 |
| 64 | 3104, 3380, 3656, 3932, 4208, 4484, 4760, 5036, 7520, 7796, 8072, 8348, 8624, 8900, 9176, 9452 | 5312, 5588, 5864, 6140, 6416, 6692, 6968, 7244 |
| 65 | 3105, 3381, 3657, 3933, 4209, 4485, 4761, 5037, 7521, 7797, 8073, 8349, 8625, 8901, 9177, 9453 | 5313, 5589, 5865, 6141, 6417, 6693, 6969, 7245 |
| 66 | 3106, 3382, 3658, 3934, 4210, 4486, 4762, 5038, 7522, 7798, 8074, 8350, 8626, 8902, 9178, 9454 | 5314, 5590, 5866, 6142, 6418, 6694, 6970, 7246 |
| 67 | 3107, 3383, 3659, 3935, 4211, 4487, 4763, 5039, 7523, 7799, 8075, 8351, 8627, 8903, 9179, 9455 | 5315, 5591, 5867, 6143, 6419, 6695, 6971, 7247 |
| 68 | 3108, 3384, 3660, 3936, 4212, 4488, 4764, 5040, 7524, 7800, 8076, 8352, 8628, 8904, 9180, 9456 | 5316, 5592, 5868, 6144, 6420, 6696, 6972, 7248 |
| 69 | 3109, 3385, 3661, 3937, 4213, 4489, 4765, 5041, 7525, 7801, 8077, 8353, 8629, 8905, 9181, 9457 | 5317, 5593, 5869, 6145, 6421, 6697, 6973, 7249 |
| 70 | 3110, 3386, 3662, 3938, 4214, 4490, 4766, 5042, 7526, 7802, 8078, 8354, 8630, 8906, 9182, 9458 | 5318, 5594, 5870, 6146, 6422, 6698, 6974, 7250 |
| 71 | 3111, 3387, 3663, 3939, 4215, 4491, 4767, 5043, 7527, 7803, 8079, 8355, 8631, 8907, 9183, 9459 | 5319, 5595, 5871, 6147, 6423, 6699, 6975, 7251 |
| 72 | 3112, 3388, 3664, 3940, 4216, 4492, 4768, 5044, 7528, 7804, 8080, 8356, 8632, 8908, 9184, 9460 | 5320, 5596, 5872, 6148, 6424, 6700, 6976, 7252 |
| 73 | 3113, 3389, 3665, 3941, 4217, 4493, 4769, 5045, 7529, 7805, 8081, 8357, 8633, 8909, 9185, 9461 | 5321, 5597, 5873, 6149, 6425, 6701, 6977, 7253 |
| 74 | 3114, 3390, 3666, 3942, 4218, 4494, 4770, 5046, 7530, 7806, 8082, 8358, 8634, 8910, 9186, 9462 | 5322, 5598, 5874, 6150, 6426, 6702, 6978, 7254 |
| 75 | 3116, 3392, 3668, 3944, 4220, 4496, 4772, 5048, 7532, 7808, 8084, 8360, 8636, 8912, 9188, 9464 | 5324, 5600, 5876, 6152, 6428, 6704, 6980, 7256 |
| 76 | 3117, 3393, 3669, 3945, 4221, 4497, 4773, 5049, 7533, 7809, 8085, 8361, 8637, 8913, 9189, 9465 | 5325, 5601, 5877, 6153, 6429, 6705, 6981, 7257 |
| 77 | 3118, 3394, 3670, 3946, 4222, 4498, 4774, 5050, 7534, 7810, 8086, 8362, 8638, 8914, 9190, 9466 | 5326, 5602, 5878, 6154, 6430, 6706, 6982, 7258 |
| 78 | 3119, 3395, 3671, 3947, 4223, 4499, 4775, 5051, 7535, 7811, 8087, 8363, 8639, 8915, 9191, 9467 | 5327, 5603, 5879, 6155, 6431, 6707, 6983, 7259 |

In certain embodiments, the at least one polypeptide encoded by the at least one coding region of the inventive artificial nucleic acid comprises or consists of Zika virus premembrane protein (prM), or a fragment or variant thereof, and of Zika virus envelope protein (E), or a fragment or variant thereof (prME protein), or, alternatively, Zika virus membrane protein (M), or a fragment or variant thereof, and of Zika virus envelope protein (E), or a fragment or variant thereof (ME protein), wherein the the prME protein or the ME protein further comprises a signal sequence (signal peptide). Preferably, that signal sequence is a heterologous signal sequence, which is not derived from Zika virus, such as signal sequence from a non-related protein. More preferably, that signal sequence comprises or consists of an amino acid sequence according to any one of SEQ ID NO: 10961-10964, 10966 or 10967, or a fragment or variant thereof.

TABLE 6

Amino acid sequences of Zika virus prME proteins and Zika virus ME proteins comprising a heterologous signal sequence and respective nucleic acid sequences

| Row | column 1<br>NCBI<br>Accession No. | column 2<br>A | column 3<br>B | column 4<br>C |
|---|---|---|---|---|
| 1 | KU321639.1 | 9641 | 9681 | 9721, 9761, 9801, 9841, 9881, 9921, 9961 |
| 2 | KU312312.1 | 9642 | 9682 | 9722, 9762, 9802, 9842, 9882, 9922, 9962 |
| 3 | AY632535.2 | 9643 | 9683 | 9723, 9763, 9803, 9843, 9883, 9923, 9963 |
| 4 | KU527068.1 | 9644 | 9684 | 9724, 9764, 9804, 9844, 9884, 9924, 9964 |
| 5 | KU321639.1 | 9645 | 9685 | 9725, 9765, 9805, 9845, 9885, 9925, 9965 |

TABLE 6-continued

Amino acid sequences of Zika virus prME proteins and Zika virus ME proteins comprising a heterologous signal sequence and respective nucleic acid sequences

| Row | column 1 NCBI Accession No. | column 2 A | column 3 B | column 4 C |
|---|---|---|---|---|
| 6 | KU312312.1 | 9646 | 9686 | 9726, 9766, 9806, 9846, 9886, 9926, 9966 |
| 7 | AY632535.2 | 9647 | 9687 | 9727, 9767, 9807, 9847, 9887, 9927, 9967 |
| 8 | KU527068.1 | 9648 | 9688 | 9728, 9768, 9808, 9848, 9888, 9928, 9968 |
| 9 | KU321639.1 | 9649 | 9689 | 9729, 9769, 9809, 9849, 9889, 9929, 9969 |
| 10 | KU312312.1 | 9650 | 9690 | 9730, 9770, 9810, 9850, 9890, 9930, 9970 |
| 11 | AY632535.2 | 9651 | 9691 | 9731, 9771, 9811, 9851, 9891, 9931, 9971 |
| 12 | KU527068.1 | 9652 | 9692 | 9732, 9772, 9812, 9852, 9892, 9932, 9972 |
| 13 | KU321639.1 | 9653 | 9693 | 9733, 9773, 9813, 9853, 9893, 9933, 9973 |
| 14 | KU312312.1 | 9654 | 9694 | 9734, 9774, 9814, 9854, 9894, 9934, 9974 |
| 15 | AY632535.2 | 9655 | 9695 | 9735, 9775, 9815, 9855, 9895, 9935, 9975 |
| 16 | KU527068.1 | 9656 | 9696 | 9736, 9776, 9816, 9856, 9896, 9936, 9976 |
| 17 | KU321639.1 | 9657 | 9697 | 9737, 9777, 9817, 9857, 9897, 9937, 9977 |
| 18 | KU312312.1 | 9658 | 9698 | 9738, 9778, 9818, 9858, 9898, 9938, 9978 |
| 19 | AY632535.2 | 9659 | 9699 | 9739, 9779, 9819, 9859, 9899, 9939, 9979 |
| 20 | KU527068.1 | 9660 | 9700 | 9740, 9780, 9820, 9860, 9900, 9940, 9980 |
| 21 | KU321639.1 | 9661 | 9701 | 9741, 9781, 9821, 9861, 9901, 9941, 9981 |
| 22 | KU312312.1 | 9662 | 9702 | 9742, 9782, 9822, 9862, 9902, 9942, 9982 |
| 23 | AY632535.2 | 9663 | 9703 | 9743, 9783, 9823, 9863, 9903, 9943, 9983 |
| 24 | KU527068.1 | 9664 | 9704 | 9744, 9784, 9824, 9864, 9904, 9944, 9984 |
| 25 | KU321639.1 | 10968 | 10992 | 11016, 11040, 11064, 11088, 11112, 11136, 11160 |
| 26 | KU312312.1 | 10969 | 10993 | 11017, 11041, 11065, 11089, 11113, 11137, 11161 |
| 27 | AY632535.2 | 10970 | 10994 | 11018, 11042, 11066, 11090, 11114, 11138, 11162 |
| 28 | KU527068.1 | 10971 | 10995 | 11019, 11043, 11067, 11091, 11115, 11139, 11163 |
| 29 | KU321639.1 | 10972 | 10996 | 11020, 11044, 11068, 11092, 11116, 11140, 11164 |
| 30 | KU312312.1 | 10973 | 10997 | 11021, 11045, 11069, 11093, 11117, 11141, 11165 |
| 31 | AY632535.2 | 10974 | 10998 | 11022, 11046, 11070, 11094, 11118, 11142, 11166 |
| 32 | KU527068.1 | 10975 | 10999 | 11023, 11047, 11071, 11095, 11119, 11143, 11167 |
| 33 | KU321639.1 | 10976 | 11000 | 11024, 11048, 11072, 11096, 11120, 11144, 11168 |
| 34 | KU312312.1 | 10977 | 11001 | 11025, 11049, 11073, 11097, 11121, 11145, 11169 |
| 35 | AY632535.2 | 10978 | 11002 | 11026, 11050, 11074, 11098, 11122, 11146, 11170 |
| 36 | KU527068.1 | 10979 | 11003 | 11027, 11051, 11075, 11099, 11123, 11147, 11171 |
| 37 | KU321639.1 | 10980 | 11004 | 11028, 11052, 11076, 11100, 11124, 11148, 11172 |
| 38 | KU312312.1 | 10981 | 11005 | 11029, 11053, 11077, 11101, 11125, 11149, 11173 |
| 39 | AY632535.2 | 10982 | 11006 | 11030, 11054, 11078, 11102, 11126, 11150, 11174 |
| 40 | KU527068.1 | 10983 | 11007 | 11031, 11055, 11079, 11103, 11127, 11151, 11175 |
| 41 | KU321639.1 | 9665 | 9705 | 9745, 9785, 9825, 9865, 9905, 9945, 9985 |
| 42 | KU312312.1 | 9666 | 9706 | 9746, 9786, 9826, 9866, 9906, 9946, 9986 |
| 43 | AY632535.2 | 9667 | 9707 | 9747, 9787, 9827, 9867, 9907, 9947, 9987 |
| 44 | KU527068.1 | 9668 | 9708 | 9748, 9788, 9828, 9868, 9908, 9948, 9988 |
| 45 | KU321639.1 | 9669 | 9709 | 9749, 9789, 9829, 9869, 9909, 9949, 9989 |
| 46 | KU312312.1 | 9670 | 9710 | 9750, 9790, 9830, 9870, 9910, 9950, 9990 |
| 47 | AY632535.2 | 9671 | 9711 | 9751, 9791, 9831, 9871, 9911, 9951, 9991 |
| 48 | KU527068.1 | 9672 | 9712 | 9752, 9792, 9832, 9872, 9912, 9952, 9992 |
| 49 | KU321639.1 | 9673 | 9713 | 9753, 9793, 9833, 9873, 9913, 9953, 9993 |
| 50 | KU312312.1 | 9674 | 9714 | 9754, 9794, 9834, 9874, 9914, 9954, 9994 |
| 51 | AY632535.2 | 9675 | 9715 | 9755, 9795, 9835, 9875, 9915, 9955, 9995 |
| 52 | KU527068.1 | 9676 | 9716 | 9756, 9796, 9836, 9876, 9916, 9956, 9996 |
| 53 | KU321639.1 | 9677 | 9717 | 9757, 9797, 9837, 9877, 9917, 9957, 9997 |
| 54 | KU312312.1 | 9678 | 9718 | 9758, 9798, 9838, 9878, 9918, 9958, 9998 |
| 55 | AY632535.2 | 9679 | 9719 | 9759, 9799, 9839, 9879, 9919, 9959, 9999 |
| 56 | KU527068.1 | 9680 | 9720 | 9760, 9800, 9840, 9880, 9920, 9960, 10000 |
| 57 | KU321639.1 | 10984 | 11008 | 11032, 11056, 11080, 11104, 11128, 11152, 11176 |
| 58 | KU312312.1 | 10985 | 11009 | 11033, 11057, 11081, 11105, 11129, 11153, 11177 |
| 59 | AY632535.2 | 10986 | 11010 | 11034, 11058, 11082, 11106, 11130, 11154, 11178 |
| 60 | KU527068.1 | 10987 | 11011 | 11035, 11059, 11083, 11107, 11131, 11155, 11179 |
| 61 | KU321639.1 | 10988 | 11012 | 11036, 11060, 11084, 11108, 11132, 11156, 11180 |
| 62 | KU312312.1 | 10989 | 11013 | 11037, 11061, 11085, 11109, 11133, 11157, 11181 |
| 63 | AY632535.2 | 10990 | 11014 | 11038, 11062, 11086, 11110, 11134, 11158, 11182 |
| 64 | KU527068.1 | 10991 | 11015 | 11039, 11063, 11087, 11111, 11135, 11159, 11183 |

In a preferred embodiment, the at least one polypeptide encoded by the at least one coding region of the inventive artificial nucleic acid comprises or consists of Zika virus prME protein or Zika virus ME protein as defined by an accession number indicated in the first column ("NCBI Accession No.") in Table 6 or by any one of the amino acid sequences in the second column ("A") in Table 6 (SEQ ID NO: 9641-9664, 10968-10983, 9665-9680 or 10984-10991), or a fragment or variant of any one of these sequences.

In this context, it is particularly preferred that the at least one polypeptide encoded by the at least one coding region of the inventive artificial nucleic acid comprises or consists of an amino acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences as defined by an accession number indicated in the first column ("NCBI Accession No.") in Table 6 or by any one of the amino acid sequences in the second column ("A") in Table 6 (SEQ ID NO: 9641-9664, 10968-10983, 9665-9680 or 10984-10991), or a fragment or variant of any one of these sequences.

It is further preferred that the at least one coding region of the artificial nucleic acid according to the invention comprises or consists of a nucleic acid sequence as defined by an accession number indicated in the first column ("NCBI Accession No.") in Table 6 or by any one of the nucleic acid sequences in the third column ("B") in Table 6, (SEQ ID NO: 9681-9704, 10992-11007, 9705-9720 or 11008-11015), or a fragment or variant of any one of these sequences.

Preferably, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences as defined by an accession number indicated in the first column ("NCBI Accession No.") in Table 6 or by any one of the nucleic acid sequences in the third column ("B") in Table 6, (SEQ ID NO: 9681-9704, 10992-11007, 9705-9720 or 11008-11015), or a fragment or variant of any one of these sequences.

It is further preferred that the at least one coding region of the artificial nucleic acid according to the invention comprises or consists of a modified nucleic acid sequence as defined by any one of the nucleic acid sequences in the fourth column ("C") in Table 6 (SEQ ID NO: 9721-9744, 11016-11031, 9745-9760, 11032-11039, 9761-9784, 11040-11055, 9785-9800, 11056-11063, 9801-9824, 11064-11079, 9825-9840, 11080-11087, 9841-9864, 11088-11103, 9865-9880, 11104-11111, 9881-9904, 11112-11127, 9905-9920, 11128-11135, 9921-9944, 11136-11151, 9945-9960, 11152-11159, 9961-9984, 11160-11175, 9985-10000, or 11176-11183), or a fragment or variant of any one of these sequences.

Preferably, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the fourth column ("C") in Table 6 (SEQ ID NO: 9721-9744, 11016-11031, 9745-9760, 11032-11039, 9761-9784, 11040-11055, 9785-9800, 11056-11063, 9801-9824, 11064-11079, 9825-9840, 11080-11087, 9841-9864, 11088-11103, 9865-9880, 11104-11111, 9881-9904, 11112-11127, 9905-9920, 11128-11135, 9921-9944, 11136-11151, 9945-9960, 11152-11159, 9961-9984, 11160-11175, 9985-10000, or 11176-11183), or a fragment or variant of any one of these sequences.

In a particularly preferred embodiment, the at least one polypeptide encoded by the at least one coding region of the inventive artificial nucleic acid comprises or consists of Zika virus protein, preferably ME or prME protein, or a fragment or variant thereof, wherein the at least one coding region comprises or consists of a nucleic acid sequence as defined by any one of the nucleic acid sequences in the first column ("A") in Table 6A (SEQ ID NO: 10001-10024, 11184-11199, 10025-10040, 11200-11207, 10041-10064, 11208-11223, 10065-10080, 11224-11231, 10081-10104, 11232-11247, 10105-10120, 11248-11255, 10121-10144, 11256-11271, 10145-10160, 11272-11279, 10161-10184, 11280-11295, 10185-10200, 11296-11303, 10201-10224, 11304-11319, 10225-10240, 11320-11327, 10241-10264, 11328-11343, 10265-10280, 11344-11351, 10281-10304, 11352-11367, 10305-10320, 11368-11375, 10641-10664, 11568-11583, 10665-10680, 11584-11591, 10681-10704, 11592-11607, 10705-10720, 11608-11615, 10721-10744, 11616-11631, 10745-10760, 11632-11639, 10761-10784, 11640-11655, 10785-10800, 11656-11663, 10801-10824, 11664-11679, 10825-10840, 11680-11687, 10841-10864, 11688-11703, 10865-10880, 11704-11711, 10881-10904, 11712-11727, 10905-10920, 11728-11735, 10921-10944, 11736-11751, 10945-10960, or 11752-11759), or as defined by any one of the nucleic acid sequences in the second column ("B") in Table 6A (10321-10344, 11376-11391, 10345-10360, 11392-11399, 10361-10384, 11400-11415, 10385-10400, 11416-11423, 10401-10424, 11424-11439, 10425-10440, 11440-11447, 10441-10464, 11448-11463, 10465-10480, 11464-11471, 10481-10504, 11472-11487, 10505-10520, 11488-11495, 10521-10544, 11496-11511, 10545-10560, 11512-11519, 10561-10584, 11520-11535, 10585-10600, 11536-11543, 10601-10624, 11544-11559, 10625-10640, or 11560-11567) or a fragment or variant of any one of these sequences.

Alternatively, the at least one coding region of the artificial nucleic acid according to the invention comprises or consists of a nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 6A (SEQ ID NO: 10001-10024, 11184-11199, 10025-10040, 11200-11207, 10041-10064, 11208-11223, 10065-10080, 11224-11231, 10081-10104, 11232-11247, 10105-10120, 11248-11255, 10121-10144, 11256-11271, 10145-10160, 11272-11279, 10161-10184, 11280-11295, 10185-10200, 11296-11303, 10201-10224, 11304-11319, 10225-10240, 11320-11327, 10241-10264, 11328-11343, 10265-10280, 11344-11351, 10281-10304, 11352-11367, 10305-10320, 11368-11375, 10641-10664, 11568-11583, 10665-10680, 11584-11591, 10681-10704, 11592-11607, 10705-10720, 11608-11615, 10721-10744, 11616-11631, 10745-10760, 11632-11639, 10761-10784, 11640-11655, 10785-10800, 11656-11663, 10801-10824, 11664-11679, 10825-10840, 11680-11687, 10841-10864, 11688-11703, 10865-10880, 11704-11711, 10881-10904, 11712-11727, 10905-10920, 11728-11735, 10921-10944, 11736-11751, 10945-10960, or 11752-11759), or as defined by any one of the nucleic acid sequences in the second column ("B") in Table 6A (10321-10344, 11376-11391, 10345-10360, 11392-11399, 10361-10384, 11400-11415, 10385-10400, 11416-11423, 10401-10424, 11424-11439, 10425-10440, 11440-11447, 10441-10464, 11448-11463, 10465-10480, 11464-11471, 10481-10504, 11472-11487, 10505-10520, 11488-11495, 10521-10544, 11496-11511, 10545-10560, 11512-11519, 10561-10584, 11520-11535, 10585-10600, 11536-11543, 10601-10624, 11544-11559, 10625-10640, or 11560-11567) or a fragment or variant of any one of these sequences.

More preferably, the at least one polypeptide encoded by the at least one coding region of the inventive artificial nucleic acid comprises or consists of Zika virus protein, preferably ME or prME protein, or a fragment or variant thereof, wherein the at least one coding region comprises or consists of a modified nucleic acid sequence as defined by any one of the nucleic acid sequences in the first column ("A") in Table 6A (10041-10064, 11208-11223, 10065-10080, 11224-11231, 10081-10104, 11232-11247, 10105-10120, 11248-11255, 10121-10144, 11256-11271, 10145-10160, 11272-11279, 10161-10184, 11280-11295, 10185-10200, 11296-11303, 10201-10224, 11304-11319, 10225-10240, 11320-11327, 10241-10264, 11328-11343, 10265-10280, 11344-11351, 10281-10304, 11352-11367, 10305-10320, 11368-11375, 10681-10704, 11592-11607, 10720, 11608-11615, 10721-10744, 11616-11631, 10745-10760, 11632-11639, 10761-10784, 11640-11655, 10785-

10800, 11656-11663, 10801-10824, 11664-11679, 10825-10840, 11680-11687, 10841-10864, 11688-11703, 10865-10880, 11704-11711, 10881-10904, 11712-11727, 10905-10920, 11728-11735, 10921-10944, 11736-11751, 10945-10960, or 11752-11759), or as defined by any one of the nucleic acid sequences in the second column ("B") in Table 6A (10361-10384, 11400-11415, 10385-10400, 11416-11423, 10401-10424, 11424-11439, 10425-10440, 11440-11447, 10441-10464, 11448-11463, 10465-10480, 11464-11471, 10481-10504, 11472-11487, 10505-10520, 11488-11495, 10521-10544, 11496-11511, 10545-10560, 11512-11519, 10561-10584, 11520-11535, 10585-10600, 11536-11543, 10601-10624, 11544-11559, 10625-10640, or 11560-11567) or a fragment or variant of any one of these sequences.

Alternatively, the at least one coding region of the artificial nucleic acid according to the invention comprises or consists of a modified nucleic acid sequence identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences in the first column ("A") in Table 6A (10041-10064, 11208-11223, 10065-10080, 11224-11231, 10081-10104, 11232-11247, 10105-10120, 11248-11255, 10121-10144, 11256-11271, 10145-10160, 11272-11279, 10161-10184, 11280-11295, 10185-10200, 11296-11303, 10201-10224, 11304-11319, 10225-10240, 11320-11327, 10241-10264, 11328-11343, 10265-10280, 11344-11351, 10281-10304, 11352-11367, 10305-10320, 11368-11375, 10681-10704, 11592-11607, 10705-10720, 11608-11615, 10721-10744, 11616-11631, 10745-10760, 11632-11639, 10761-10784, 11640-11655, 10785-10800, 11656-11663, 10801-10824, 11664-11679, 10825-10840, 11680-11687, 10841-10864, 11688-11703, 10865-10880, 11704-11711, 10881-10904, 11712-11727, 10905-10920, 11728-11735, 10921-10944, 11736-11751, 10945-10960, or 11752-11759), or as defined by any one of the nucleic acid sequences in the second column ("B") in Table 6A (10361-10384, 11400-11415, 10385-10400, 11416-11423, 10401-10424, 11424-11439, 10425-10440, 11440-11447, 10441-10464, 11448-11463, 10465-10480, 11464-11471, 10481-10504, 11472-11487, 10505-10520, 11488-11495, 10521-10544, 11496-11511, 10545-10560, 11512-11519, 10561-10584, 11520-11535, 10585-10600, 11536-11543, 10601-10624, 11544-11559, 10625-10640, or 11560-11567) or a fragment or variant of any one of these sequences.

TABLE 6A

Nucleic acid sequences encoding Zika virus prME proteins and Zika virus ME proteins comprising a (heterologous) signal sequence, or a fragment or variant thereof

| Row | column 1<br>A | column 2<br>B |
|---|---|---|
| 1 | 10001, 10041, 10081, 10121, 10161, 10201, 10241, 10281, 10641, 10681, 10721, 10761, 10801, 10841, 10881, 10921 | 10321, 10361, 10401, 10441, 10481, 10521, 10561, 10601 |
| 2 | 10002, 10042, 10082, 10122, 10162, 10202, 10242, 10282, 10642, 10682, 10722, 10762, 10802, 10842, 10882, 10922 | 10322, 10362, 10402, 10442, 10482, 10522, 10562, 10602 |
| 3 | 10003, 10043, 10083, 10123, 10163, 10203, 10243, 10283, 10643, 10683, 10723, 10763, 10803, 10843, 10883, 10923 | 10323, 10363, 10403, 10443, 10483, 10523, 10563, 10603 |
| 4 | 10004, 10044, 10084, 10124, 10164, 10204, 10244, 10284, 10644, 10684, 10724, 10764, 10804, 10844, 10884, 10924 | 10324, 10364, 10404, 10444, 10484, 10524, 10564, 10604 |
| 5 | 10005, 10045, 10085, 10125, 10165, 10205, 10245, 10285, 10645, 10685, 10725, 10765, 10805, 10845, 10885, 10925 | 10325, 10365, 10405, 10445, 10485, 10525, 10565, 10605 |
| 6 | 10006, 10046, 10086, 10126, 10166, 10206, 10246, 10286, 10646, 10686, 10726, 10766, 10806, 10846, 10886, 10926 | 10326, 10366, 10406, 10446, 10486, 10526, 10566, 10606 |
| 7 | 10007, 10047, 10087, 10127, 10167, 10207, 10247, 10287, 10647, 10687, 10727, 10767, 10807, 10847, 10887, 10927 | 10327, 10367, 10407, 10447, 10487, 10527, 10567, 10607 |
| 8 | 10008, 10048, 10088, 10128, 10168, 10208, 10248, 10288, 10648, 10688, 10728, 10768, 10808, 10848, 10888, 10928 | 10328, 10368, 10408, 10448, 10488, 10528, 10568, 10608 |
| 9 | 10009, 10049, 10089, 10129, 10169, 10209, 10249, 10289, 10649, 10689, 10729, 10769, 10809, 10849, 10889, 10929 | 10329, 10369, 10409, 10449, 10489, 10529, 10569, 10609 |
| 10 | 10010, 10050, 10090, 10130, 10170, 10210, 10250, 10290, 10650, 10690, 10730, 10770, 10810, 10850, 10890, 10930 | 10330, 10370, 10410, 10450, 10490, 10530, 10570, 10610 |
| 11 | 10011, 10051, 10091, 10131, 10171, 10211, 10251, 10291, 10651, 10691, 10731, 10771, 10811, 10851, 10891, 10931 | 10331, 10371, 10411, 10451, 10491, 10531, 10571, 10611 |
| 12 | 10012, 10052, 10092, 10132, 10172, 10212, 10252, 10292, 10652, 10692, 10732, 10772, 10812, 10852, 10892, 10932 | 10332, 10372, 10412, 10452, 10492, 10532, 10572, 10612 |
| 13 | 10013, 10053, 10093, 10133, 10173, 10213, 10253, 10293, 10653, 10693, 10733, 10773, 10813, 10853, 10893, 10933 | 10333, 10373, 10413, 10453, 10493, 10533, 10573, 10613 |
| 14 | 10014, 10054, 10094, 10134, 10174, 10214, 10254, 10294, 10654, 10694, 10734, 10774, 10814, 10854, 10894, 10934 | 10334, 10374, 10414, 10454, 10494, 10534, 10574, 10614 |
| 15 | 10015, 10055, 10095, 10135, 10175, 10215, 10255, 10295, 10655, 10695, 10735, 10775, 10815, 10855, 10895, 10935 | 10335, 10375, 10415, 10455, 10495, 10535, 10575, 10615 |
| 16 | 10016, 10056, 10096, 10136, 10176, 10216, 10256, 10296, 10656, 10696, 10736, 10776, 10816, 10856, 10896, 10936 | 10336, 10376, 10416, 10456, 10496, 10536, 10576, 10616 |
| 17 | 10017, 10057, 10097, 10137, 10177, 10217, 10257, 10297, 10657, 10697, 10737, 10777, 10817, 10857, 10897, 10937 | 10337, 10377, 10417, 10457, 10497, 10537, 10577, 10617 |
| 18 | 10018, 10058, 10098, 10138, 10178, 10218, 10258, 10298, 10658, 10698, 10738, 10778, 10818, 10858, 10898, 10938 | 10338, 10378, 10418, 10458, 10498, 10538, 10578, 10618 |
| 19 | 10019, 10059, 10099, 10139, 10179, 10219, 10259, 10299, 10659, 10699, 10739, 10779, 10819, 10859, 10899, 10939 | 10339, 10379, 10419, 10459, 10499, 10539, 10579, 10619 |
| 20 | 10020, 10060, 10100, 10140, 10180, 10220, 10260, 10300, 10660, 10700, 10740, 10780, 10820, 10860, 10900, 10940 | 10340, 10380, 10420, 10460, 10500, 10540, 10580, 10620 |
| 21 | 10021, 10061, 10101, 10141, 10181, 10221, 10261, 10301, 10661, 10701, 10741, 10781, 10821, 10861, 10901, 10941 | 10341, 10381, 10421, 10461, 10501, 10541, 10581, 10621 |
| 22 | 10022, 10062, 10102, 10142, 10182, 10222, 10262, 10302, 10662, 10702, 10742, 10782, 10822, 10862, 10902, 10942 | 10342, 10382, 10422, 10462, 10502, 10542, 10582, 10622 |

TABLE 6A-continued Nucleic acid sequences encoding Zika virus prME proteins and Zika virus ME proteins
comprising a (heterologous) signal sequence, or a fragment or variant thereof

| Row | column 1<br>A | column 2<br>B |
|---|---|---|
| 23 | 10023, 10063, 10103, 10143, 10183, 10223, 10263, 10303, 10663, 10703, 10743, 10783, 10823, 10863, 10903, 10943 | 10343, 10383, 10423, 10463, 10503, 10543, 10583, 10623 |
| 24 | 10024, 10064, 10104, 10144, 10184, 10224, 10264, 10304, 10664, 10704, 10744, 10784, 10824, 10864, 10904, 10944 | 10344, 10384, 10424, 10464, 10504, 10544, 10584, 10624 |
| 25 | 11184, 11208, 11232, 11256, 11280, 11304, 11328, 11352, 11568, 11592, 11616, 11640, 11664, 11688, 11712, 11736 | 11376, 11400, 11424, 11448, 11472, 11496, 11520, 11544 |
| 26 | 11185, 11209, 11233, 11257, 11281, 11305, 11329, 11353, 11569, 11593, 11617, 11641, 11665, 11689, 11713, 11737 | 11377, 11401, 11425, 11449, 11473, 11497, 11521, 11545 |
| 27 | 11186, 11210, 11234, 11258, 11282, 11306, 11330, 11354, 11570, 11594, 11618, 11642, 11666, 11690, 11714, 11738 | 11378, 11402, 11426, 11450, 11474, 11498, 11522, 11546 |
| 28 | 11187, 11211, 11235, 11259, 11283, 11307, 11331, 11355, 11571, 11595, 11619, 11643, 11667, 11691, 11715, 11739 | 11379, 11403, 11427, 11451, 11475, 11499, 11523, 11547 |
| 29 | 11188, 11212, 11236, 11260, 11284, 11308, 11332, 11356, 11572, 11596, 11620, 11644, 11668, 11692, 11716, 11740 | 11380, 11404, 11428, 11452, 11476, 11500, 11524, 11548 |
| 30 | 11189, 11213, 11237, 11261, 11285, 11309, 11333, 11357, 11573, 11597, 11621, 11645, 11669, 11693, 11717, 11741 | 11381, 11405, 11429, 11453, 11477, 11501, 11525, 11549 |
| 31 | 11190, 11214, 11238, 11262, 11286, 11310, 11334, 11358, 11574, 11598, 11622, 11646, 11670, 11694, 11718, 11742 | 11382, 11406, 11430, 11454, 11478, 11502, 11526, 11550 |
| 32 | 11191, 11215, 11239, 11263, 11287, 11311, 11335, 11359, 11575, 11599, 11623, 11647, 11671, 11695, 11719, 11743 | 11383, 11407, 11431, 11455, 11479, 11503, 11527, 11551 |
| 33 | 11192, 11216, 11240, 11264, 11288, 11312, 11336, 11360, 11576, 11600, 11624, 11648, 11672, 11696, 11720, 11744 | 11384, 11408, 11432, 11456, 11480, 11504, 11528, 11552 |
| 34 | 11193, 11217, 11241, 11265, 11289, 11313, 11337, 11361, 11577, 11601, 11625, 11649, 11673, 11697, 11721, 11745 | 11385, 11409, 11433, 11457, 11481, 11505, 11529, 11553 |
| 35 | 11194, 11218, 11242, 11266, 11290, 11314, 11338, 11362, 11578, 11602, 11626, 11650, 11674, 11698, 11722, 11746 | 11386, 11410, 11434, 11458, 11482, 11506, 11530, 11554 |
| 36 | 11195, 11219, 11243, 11267, 11291, 11315, 11363, 11579, 11603, 11627, 11651, 11675, 11699, 11723, 11747 | 11387, 11411, 11435, 11459, 11483, 11507, 11531, 11555 |
| 37 | 11196, 11220, 11244, 11268, 11292, 11316, 11340, 11364, 11580, 11604, 11628, 11652, 11676, 11700, 11724, 11748 | 11388, 11412, 11436, 11460, 11484, 11508, 11532, 11556 |
| 38 | 11197, 11221, 11245, 11269, 11293, 11317, 11341, 11365, 11581, 11605, 11629, 11653, 11677, 11701, 11725, 11749 | 11389, 11413, 11437, 11461, 11485, 11509, 11533, 11557 |
| 39 | 11198, 11222, 11246, 11270, 11294, 11318, 11342, 11366, 11582, 11606, 11630, 11654, 11678, 11702, 11726, 11750 | 11390, 11414, 11438, 11462, 11486, 11510, 11534, 11558 |
| 40 | 11199, 11223, 11247, 11271, 11295, 11319, 11343, 11367, 11583, 11607, 11631, 11655, 11679, 11703, 11727, 11751 | 11391, 11415, 11439, 11463, 11487, 11511, 11535, 11559 |
| 41 | 10025, 10065, 10105, 10145, 10185, 10225, 10265, 10305, 10665, 10705, 10745, 10785, 10825, 10865, 10905, 10945 | 10345, 10385, 10425, 10465, 10505, 10545, 10585, 10625 |
| 42 | 10026, 10066, 10106, 10146, 10186, 10226, 10266, 10306, 10666, 10706, 10746, 10786, 10826, 10866, 10906, 10946 | 10346, 10386, 10426, 10466, 10506, 10546, 10586, 10626 |
| 43 | 10027, 10067, 10107, 10147, 10187, 10227, 10267, 10307, 10667, 10707, 10747, 10787, 10827, 10867, 10907, 10947 | 10347, 10387, 10427, 10467, 10507, 10547, 10587, 10627 |
| 44 | 10028, 10068, 10108, 10148, 10188, 10228, 10268, 10308, 10668, 10708, 10748, 10788, 10828, 10868, 10908, 10948 | 10348, 10388, 10428, 10468, 10508, 10548, 10588, 10628 |
| 45 | 10029, 10069, 10109, 10149, 10189, 10229, 10269, 10309, 10669, 10709, 10749, 10789, 10829, 10869, 10909, 10949 | 10349, 10389, 10429, 10469, 10509, 10549, 10589, 10629 |
| 46 | 10030, 10070, 10110, 10150, 10190, 10230, 10270, 10310, 10670, 10710, 10750, 10790, 10830, 10870, 10910, 10950 | 10350, 10390, 10430, 10470, 10510, 10550, 10590, 10630 |
| 47 | 10031, 10071, 10111, 10151, 10191, 10231, 10271, 10311, 10671, 10711, 10751, 10791, 10831, 10871, 10911, 10951 | 10351, 10391, 10431, 10471, 10511, 10551, 10591, 10631 |
| 48 | 10032, 10072, 10112, 10152, 10192, 10232, 10272, 10312, 10672, 10712, 10752, 10792, 10832, 10872, 10912, 10952 | 10352, 10392, 10432, 10472, 10512, 10552, 10592, 10632 |
| 49 | 10033, 10073, 10113, 10153, 10193, 10233, 10273, 10313, 10673, 10713, 10753, 10793, 10833, 10873, 10913, 10953 | 10353, 10393, 10433, 10473, 10513, 10553, 10593, 10633 |
| 50 | 10034, 10074, 10114, 10154, 10194, 10234, 10274, 10314, 10674, 10714, 10754, 10794, 10834, 10874, 10914, 10954 | 10354, 10394, 10434, 10474, 10514, 10554, 10594, 10634 |
| 51 | 10035, 10075, 10115, 10155, 10195, 10235, 10275, 10315, 10675, 10715, 10755, 10795, 10835, 10875, 10915, 10955 | 10355, 10395, 10435, 10475, 10515, 10555, 10595, 10635 |
| 52 | 10036, 10076, 10116, 10156, 10196, 10236, 10276, 10316, 10676, 10716, 10756, 10796, 10836, 10876, 10916, 10956 | 10356, 10396, 10436, 10476, 10516, 10556, 10596, 10636 |
| 53 | 10037, 10077, 10117, 10157, 10197, 10237, 10277, 10317, 10677, 10717, 10757, 10797, 10837, 10877, 10917, 10957 | 10357, 10397, 10437, 10477, 10517, 10557, 10597, 10637 |
| 54 | 10038, 10078, 10118, 10158, 10198, 10238, 10278, 10318, 10678, 10718, 10758, 10798, 10838, 10878, 10918, 10958 | 10358, 10398, 10438, 10478, 10518, 10558, 10598, 10638 |
| 55 | 10039, 10079, 10119, 10159, 10199, 10239, 10279, 10319, 10679, 10719, 10759, 10799, 10839, 10879, 10919, 10959 | 10359, 10399, 10439, 10479, 10519, 10559, 10599, 10639 |
| 56 | 10040, 10080, 10120, 10160, 10200, 10240, 10280, 10320, 10680, 10720, 10760, 10800, 10840, 10880, 10920, 10960 | 10360, 10400, 10440, 10480, 10520, 10560, 10600, 10640 |
| 57 | 11200, 11224, 11248, 11272, 11296, 11320, 11344, 11368, 11584, 11608, 11632, 11656, 11680, 11704, 11728, 11752 | 11392, 11416, 11440, 11464, 11488, 11512, 11536, 11560 |
| 58 | 11201, 11225, 11249, 11273, 11297, 11321, 11345, 11369, 11585, 11609, 11633, 11657, 11681, 11705, 11729, 11753 | 11393, 11417, 11441, 11465, 11489, 11513, 11537, 11561 |
| 59 | 11202, 11226, 11250, 11274, 11298, 11322, 11346, 11370, 11586, 11610, 11634, 11658, 11682, 11706, 11730, 11754 | 11394, 11418, 11442, 11466, 11490, 11514, 11538, 11562 |

TABLE 6A-continued

Nucleic acid sequences encoding Zika virus prME proteins and Zika virus ME proteins comprising a (heterologous) signal sequence, or a fragment or variant thereof

| Row | column 1<br>A | column 2<br>B |
|---|---|---|
| 60 | 11203, 11227, 11251, 11275, 11299, 11323, 11347, 11371, 11587, 11611, 11635, 11659, 11683, 11707, 11731, 11755 | 11395, 11419, 11443, 11467, 11491, 11515, 11539, 11563 |
| 61 | 11204, 11228, 11252, 11276, 11300, 11324, 11348, 11372, 11588, 11612, 11636, 11660, 11684, 11708, 11732, 11756 | 11396, 11420, 11444, 11468, 11492, 11516, 11540, 11564 |
| 62 | 11205, 11229, 11253, 11277, 11301, 11325, 11349, 11373, 11589, 11613, 11637, 11661, 11685, 11709, 11733, 11757 | 11397, 11421, 11445, 11469, 11493, 11517, 11541, 11565 |
| 63 | 11206, 11230, 11254, 11278, 11302, 11326, 11350, 11374, 11590, 11614, 11638, 11662, 11686, 11710, 11734, 11758 | 11398, 11422, 11446, 11470, 11494, 11518, 11542, 11566 |
| 64 | 11207, 11231, 11255, 11279, 11303, 11327, 11351, 11375, 11591, 11615, 11639, 11663, 11687, 11711, 11735, 11759 | 11399, 11423, 11447, 11471, 11495, 11519, 11543, 11567 |

In a further aspect, the present invention provides a composition comprising at least one artificial nucleic acid as described herein and a suitable carrier, preferably a pharmaceutically acceptable carrier. The inventive composition comprising the artificial nucleic acid as described herein is preferably a (pharmaceutical) composition or a vaccine as described herein.

The inventive composition may comprise either only one type of artificial nucleic acid or at least two different artificial nucleic acids. In particular, the inventive composition may comprise at least two artificial nucleic acids as described herein, wherein each of the at least two artificial nucleic acids comprises at least one coding region encoding at least one polypeptide comprising a different one of the Zika virus proteins as described herein, or a fragment or a variant of any one of these proteins. Alternatively, the composition may comprise at least two artificial nucleic acids as described herein, wherein each of the at least two artificial nucleic acids comprises at least one coding region encoding at least one polypeptide comprising at least two different Zika virus proteins as described herein, or a fragment or a variant of any one of these proteins. In another embodiment, the composition may also comprise at least two different artificial nucleic acids, which are bi- or multicistronic nucleic acids as described herein and wherein each of the artificial nucleic acids encodes at least two polypeptides, each comprising at least one Zika virus protein, or a fragment or variant thereof.

Preferably, the inventive composition comprises or consists of at least one artificial nucleic acid as described herein and a pharmaceutically acceptable carrier. The expression "pharmaceutically acceptable carrier" as used herein preferably includes the liquid or non-liquid basis of the inventive composition, which is preferably a pharmaceutical composition or a vaccine. If the inventive composition is provided in liquid form, the carrier will preferably be water, typically pyrogen-free water; isotonic saline or buffered (aqueous) solutions, e.g phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaO, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

Furthermore, one or more compatible solid or liquid fillers or diluents or encapsulating compounds may be used as well, which are suitable for administration to a person. The term "compatible" as used herein means that the constituents of the inventive composition are capable of being mixed with the the at least one artificial nucleic acid of the composition, in such a manner that no interaction occurs, which would substantially reduce the biological activity or the pharmaceutical effectiveness of the inventive composition under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from *Theobroma*; polyols, such as, for example, polypropylene glycol, glycerol, sorbitol, mannitol and polyethylene glycol; alginic acid.

Further additives which may be included in the inventive composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In a preferred embodiment, the inventive composition, which is preferably a pharmaceutical composition or a vaccine, comprises at least one artificial nucleic acid as described herein, wherein the at least one artificial nucleic acid is complexed at least partially with a cationic or polycationic compound and/or a polymeric carrier, preferably a cationic protein or peptide. Accordingly, in a further embodiment of the invention it is preferred that the at least one artificial nucleic acid as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of the artificial nucleic acid or any other nucleic acid to cationic or polycationic compound and/or with a polymeric carrier; or optionally in a nitrogen/phosphate (N/P) ratio of the artificial nucleic acid or any other nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one artificial nucleic acid to the one or more polycations is in the range of about 0.1 to 10, including a range of about 0.3 to 4, of about 0.5 to 2, of about 0.7 to 2 and of about 0.7 to 1.5.

Preferably, the inventive composition comprises at least one artificial nucleic acid as described herein, which is complexed with one or more polycations and/or a polymeric carrier, and at least one free nucleic acid, wherein the at least one complexed nucleic acid is preferably identical to the at least one artificial nucleic acid according to the present invention. In this context it is particularly preferred that the at least one artificial nucleic acid of the inventive composition is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the inventive artificial nucleic acid is complexed with a cationic compound and that the rest of the inventive artificial nucleic acid is (comprised in the inventive pharmaceutical composition or vaccine) in uncomplexed form ("free").

Preferably, the molar ratio of the complexed nucleic acid to the free nucleic acid is selected from a molar ratio of about 0.001:1 to about 1:0.001, including a ratio of about 1:1. In a preferred embodiment, the invention provides a composition comprising at least one artificial nucleic acid as described herein, wherein the ratio of complexed nucleic acid to free nucleic acid is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w).

In one embodiment, at least one artificial nucleic acid as defined herein or any other nucleic acid comprised in the inventive (pharmaceutical) composition or vaccine can also be associated with a vehicle, transfection or complexation agent for increasing the transfection efficiency and/or the immunostimulatory properties of the at least one artificial nucleic acid or of optionally comprised further included nucleic acids.

In the context of the present invention, a cationic or polycationic compound is preferably selected from any cationic or polycationic compound, suitable for complexing and thereby stabilizing a nucleic acid, particularly the at least one artificial nucleic acid of the inventive composition, e.g. by associating the at least one artificial nucleic acid with the cationic or polycationic compound. Such a cationic or polycationic compound per se does not need to exhibit any adjuvant properties, since an adjuvant property, particularly the capability of inducing an innate immune response, is preferably created upon complexing the at least one artificial nucleic acid with the cationic or polycationic compound. When complexing the at least one artificial nucleic acid with the cationic or polycationic compound, the adjuvant component is formed.

Particularly preferred, cationic or polycationic peptides or proteins (preferably also as component $P^2$ in a polymeric carrier according to formula IV herein) may be selected from protamine, nucleoline, spermine or spermidine, poly-L-lysine (PLL), basic polypeptides, poly-arginine, cell penetrating peptides (CPPs), chimeric CPPs, such as Transportan, or MPG peptides, HIV-binding peptides, Tat, HIV-1 Tat (HIV), Tat-derived peptides, oligoarginines, members of the penetratin family, e.g. Penetratin, Antennapedia-derived peptides (particularly from Drosophila antennapedia), pAntp, plsl, etc., antimicrobial-derived CPPs e.g. Buforin-2, Bac715-24, SynB, SynB(1), pVEC, hCT-derived peptides, SAP, MAP, KALA, PpTG20, Proline-rich peptides, L-oligomers, Arginine-rich peptides, Calcitonin-peptides, FGF, Lactoferrin, poly-L-Lysine, poly-Arginine, histones, VP22 derived or analog peptides, HSV, VP22 (Herpes simplex), MAP, KALA or protein transduction domains (PTDs, PpT620, prolin-rich peptides, arginine-rich peptides, lysine-rich peptides, Pep-1, Calcitonin peptide(s), etc.

According to a preferred embodiment, cationic or polycationic proteins or peptides are selected from the following proteins or peptides having the following total formula (III):

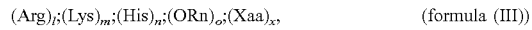

$(Arg)_l;(Lys)_m;(His)_n;(Orn)_o;(Xaa)_x$,   (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3, 4, 5, 6, 7, or 8, provided, that the overall content of Xaa does not exceed 50% of all amino acids of the oligopeptide. Preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

Further preferred cationic or polycationic compounds, which can be used for complexing the at least one artificial nucleic acid according to the invention may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]trimethylammonium, CLIP9: rac-[2(2, 3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amido-amine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc. Association or complexing the at least one artificial nucleic acid of the inventive composition with cationic or polycationic compounds preferably provides adjuvant properties to the at least one artificial nucleic acid and confers a stabilizing effect to the at least one artificial nucleic acid of the adjuvant component by complexation. The procedure for stabilizing the at least one artificial nucleic acid is in general described in EP-A-1083232, the disclosure of which is incorporated by reference into the present invention in its entirety. Particularly preferred as cationic or polycationic compounds are compounds selected from the group consisting of protamine, nucleoline, spermin, spermidine, oligoarginines as defined above, such as $Arg_7$, $Arg_8$, $Arg_9$, $Arg_7$, $H_3R_9$, $R_9H_3$, $H_3R_9H_3$, $YSSR_9SSY$, $(RKH)_4$, $Y(RKH)_2R$, etc.

According to a preferred embodiment, the inventive composition is formulated by using the at least one artificial nucleic acid according to the invention and one or more liposomes, lipoplexes, or lipid nanoparticles. In one embodiment, the inventive composition comprises liposomes. Liposomes are artificially-prepared vesicles, which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the inventive composition, in particular when applied as a pharmaceutical composition or a vaccine as described herein.

According to some preferred embodiments, the composition according to the invention comprises the artificial nucleic acid, preferably an RNA, which is complexed or associated with lipids (in particular cationic and/or neutral lipids) to form one or more lipid nanoparticles.

Preferably, lipid nanoparticles (LNPs) comprise: (a) the artificial nucleic acid according to the invention, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, LNPs comprise, in addition to the artificial nucleic acid according to the invention, in particular RNA, as defined herein), (i) at least one cationic lipid; (ii) a neutral lipid; (iii) a sterol, e.g., cholesterol; and (iv) a PEG-lipid, in a molar ratio of about 20-60% cationic lipid: 5-25% neutral lipid: 25-55% sterol; 0.5-15% PEG-lipid.

In some embodiments, the artificial nucleic acid according to the invention may be formulated in an aminoalcohol lipidoid. Aminoalcohol lipidoids which may be used in the present invention may be prepared by the methods described in U.S. Pat. No. 8,450,298, herein incorporated by reference in its entirety.

(i) Cationic Lipids

LNPs may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DM A), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl4-(dimethylamino) butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N, N-dimethylpropan-1-amine (MC3 Ether), 4-((6Z,9Z,28Z,31 Z)-heptatriaconta-6,9,28,31-tetraen-19-yloxy)-N,N-dimethylbutan-1-amine (MC4 Ether), or any combination of any of the foregoing.

Other cationic lipids include, but are not limited to, N,N-distearyl-N,N-dimethylammonium bromide (DDAB), 3β-(N—(N',N'-dimethylaminoethane)-carbamoyl)cholesterol (DC-Choi), N-(1-(2,3-dioleyloxy)propyl)-N-2-(sperminecarboxamido)ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO 09/086558, WO 09/127060, WO 10/048536, WO 10/054406, WO 10/088537, WO 10/129709, and WO 2011/153493; U.S. Patent Publication Nos. 2011/0256175, 2012/0128760, and 2012/0027803; U.S. Pat. No. 8,158,601; and Love et al, PNAS, 107(5), 1864-69, 2010.

Other suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

In some embodiments, amino or cationic lipids have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In some embodiments, the protonatable lipids have a $pK_a$ of the protonatable group in the range of about 4 to about 11, e.g., a pKa of about 5 to about 7.

LNPs can include two or more cationic lipids. The cationic lipids can be selected to contribute different advantageous properties. For example, cationic lipids that differ in properties such as amine $pK_a$, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 50% or about 40% on a molar basis (based upon 100% total moles of lipid in the lipid nanoparticle). In some embodiments, the ratio of cationic lipid to nucleic acid is from about 3 to about 15, such as from about 5 to about 13 or from about 7 to about 11.

(ii) Neutral and Non-Cationic Lipids

The non-cationic lipid can be a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., LNP size and stability of the LNP in the bloodstream. Preferably, the neutral lipid is a lipid having two acyl groups (e.g., diacylphosphatidylcholine and diacylphosphatidylethanolamine).

In some embodiments, the neutral lipids contain saturated fatty acids with carbon chain lengths in the range of 010 to C20. In other embodiments, neutral lipids with mono or diunsaturated fatty acids with carbon chain lengths in the range of C10 to 020 are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoylphosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-0-monomethyl PE, 16-O-dimethyl-PE, 18-1-trans-PE, 1-stearoyl-2-oleoyl-phosphatidyethanolamine (SOPE), cholesterol, or a mixture thereof. Anionic lipids suitable for use in LNPs include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and beta-acyloxyacids, can also be used.

In some embodiments, the non-cationic lipid is present in a ratio of from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the LNP.

In some embodiments, LNPs comprise from about 0% to about 15 or 45% on a molar basis of neutral lipid, e.g., from about 3 to about 12% or from about 5 to about 10%. For instance, LNPs may include about 15%, about 10%, about 7.5%, or about 7.1% of neutral lipid on a molar basis (based upon 100% total moles of lipid in the LNP).

(iii) Sterols

The sterol is preferably cholesterol. The sterol can be present in a ratio of about 10 mol % to about 60 mol % or about 25 mol % to about 40 mol % of the LNP. In some embodiments, the sterol is present in a ratio of about 10, 15, 20, 25, 30, 35, 40, 45, 50, 55, or about 60 mol % of the total lipid present in the LNP. In other embodiments, LNPs comprise from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

(iv) Aggregation Reducing Agents

The aggregation reducing agent can be a lipid capable of reducing aggregation. Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499 and 5,885,613, each of which is incorporated by reference in its entirety.

The aggregation reducing agent may be, for example, selected from a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cerl4 or PEG-Cer20). The PEG-DAA conjugate may be, for example, a PEG-dilauryloxypropyl (C12), a PEG-dimyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-1-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl-1-(methoxypoly(ethyleneglycol)2000)propylcarbamate)) (GalNAc-PEG-DSG); mPEG (mw2000)-diastearoylphosphatidyl-ethanolamine (PEG-DSPE); and polyethylene glycol-dipalmitoylglycerol (PEG-DPG).

In some embodiments, the aggregation reducing agent is PEG-DMG. In other embodiments, the aggregation reducing agent is PEG-c-DMA.

LNP Composition

The composition of LNPs may be influenced by, inter alia, the selection of the cationic lipid component, the degree of cationic lipid saturation, the nature of the PEGylation, the ratio of all components and biophysical parameters such as its size. In one example by Semple et al. (Semple et al. Nature Biotech. 2010 28: 172-176; herein incorporated by reference in its entirety), the LNP composition was composed of 57.1% cationic lipid, 7.1% dipalmitoylphosphatidylcholine, 34.3% cholesterol, and 1.4% PEG-c-DMA (Basha et al. Mol Ther. 2011 19:2186-2200; herein incorporated by reference in its entirety).

In some embodiments, LNPs may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to the artificial nucleic acid, preferably an RNA, may range from about 5:1 to about 20:1, from about 10:1 to about 25:1, from about 15:1 to about 30:1 and/or at least 30:1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 to about 15 mol %, per 100% total moles of lipid in the LNP. In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 1.5%, about 0.5%, or about 0.3% on a molar basis (based on 100% total moles of lipids in the LNP).

Different LNPs having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) as depicted in Table 17 below:

TABLE 17

Lipid-based formulations

| Formulation No. | Cationic Lipid | Non-Cationic (or Neutral) Lipid | Sterol | Aggregation Reducing Agent (e.g., PEG-lipid) |
|---|---|---|---|---|
| 1 | from about 35 to about 65% | from about 3 to about 12 or 15% | from about 15 to about 45% | from about 0.1 to about 10% (preferably from about 0.5 to about 2 or 3%) |
| 2 | from about 20 to about 70% | from about 5 to about 45% | from about 20 to about 55% | from about 0.1 to about 10% (preferably from about 0.5 to about 2 or 3%) |
| 3 | from about 45 to about 65% | from about 5 to about 10% | from about 25 to about 40% | from about 0.1 to about 3% |
| 4 | from about 20 to about 60% | from about 5 to about 25% | from about 25 to about 55% | from about 0.1 to about 5% (preferably from about 0.1 to about 3%) |
| 5 | about 40% | about 10% | about 40% | about 10% |
| 6 | about 35% | about 15% | about 40% | about 10% |
| 7 | about 52% | about 13% | about 30% | about 5% |
| 8 | about 50% | about 10% | about 38.5% | about 1.5% |

In some embodiments, LNPs occur as liposomes or lipoplexes as described in further detail below.

LNP Size

In some embodiments, LNPs have a median diameter size of from about 50 nm to about 300 nm, such as from about 50 nm to about 250 nm, for example, from about 50 nm to about 200 nm.

In some embodiments, smaller LNPs may be used. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 urn, less than 750 um, less than 775 um, less than 800 um, less than 825 um, less than 850 um, less than 875 um, less than 900 um, less than 925 um, less than 950 um, less than 975 um, In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, the LNP may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In other embodiments, LNPs have a single mode particle size distribution (i.e., they are not bi- or poly-modal).

Other Components

LNPs may further comprise one or more lipids and/or other components in addition to those mentioned above.

Other lipids may be included in the liposome compositions for a variety of purposes, such as to prevent lipid oxidation or to attach ligands onto the liposome surface. Any of a number of lipids may be present in LNPs, including amphipathic, neutral, cationic, and anionic lipids. Such lipids can be used alone or in combination.

Additional components that may be present in a LNP include bilayer stabilizing components such as polyamide oligomers (see, e.g., U.S. Pat. No. 6,320,017, which is incorporated by reference in its entirety), peptides, proteins, and detergents.

Liposomes

In some embodiments, the artificial nucleic acid according to the invention, preferably an RNA, is formulated as liposomes.

Cationic lipid-based liposomes are able to complex with negatively charged nucleic acids (e.g. RNAs) via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the nucleic acid is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Liposomes typically consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposomes may have one or more lipid membranes. Liposomes can be single-layered, referred to as unilamellar, or multi-layered, referred to as multilamellar.

Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are typically present as spherical vesicles and can range in size from 20 nm to a few microns.

Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The artificial nucleic acid according to the invention, preferably an RNA, may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In some embodiments, the artificial nucleic acid according to the invention, preferably an RNA, may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

Lipoplexes

In some embodiments, the artificial nucleic acid according to the invention, preferably an RNA, is formulated as lipoplexes, i.e. cationic lipid bilayers sandwiched between nucleic acid (e.g. the artificial nucleic acid in the form of RNA or DNA) layers.

Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency.

Nanoliposomes

In some embodiments, the artificial nucleic acid according to the invention, preferably an RNA, is formulated as neutral lipid-based nanoliposomes such as 1,2-dioleoyl-sn-glycero-3-phosphatidylcholine (DOPC)-based nanoliposomes (Adv Drug Deliv Rev. 2014 February; 66: 110-116.).

Emulsions

In some embodiments, the artificial nucleic acid according to the invention, preferably an RNA, is formulated as emulsions. In another embodiment, said artificial nucleic acid according to the invention, preferably an RNA, is formulated in a cationic oil-in-water emulsion where the emulsion particle comprises an oil core and a cationic lipid which can interact with the nucleic acid(s) anchoring the molecule to the emulsion particle (see International Pub. No. WO2012006380; herein incorporated by reference in its entirety). In some embodiments, said artificial nucleic acid according to the invention, preferably an RNA, is formulated in a water-in-oil emulsion comprising a continuous hydrophobic phase in which the hydrophilic phase is dispersed. As a non-limiting example, the emulsion may be made by the methods described in International Publication No. WO201087791, the contents of which are herein incorporated by reference in its entirety.

According to a preferred embodiment, the inventive composition comprises the artificial nucleic acid as described herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used in the composition according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable to complex the at least one artificial nucleic acid as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the at least one artificial nucleic acid or any further nucleic acid comprised in the inventive (pharmaceutical) composition or vaccine contains at least one —SH moiety, most preferably at least one cysteine residue or any further chemical group exhibiting an —SH moiety, capable to form a disulfide linkage upon condensation with at least one further cationic or polycationic protein, peptide or polymer as cationic component of the polymeric carrier as mentioned herein.

As defined above, the polymeric carrier, which may be used to complex the at least one artificial nucleic acid or any further nucleic acid comprised in the inventive (pharmaceutical) composition or vaccine may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined above for complexation agent.

In a further particular embodiment, the polymeric carrier which may be used to complex the at least one artificial nucleic acid or any further nucleic acid comprised in the inventive (pharmaceutical) composition or vaccine may be selected from a polymeric carrier molecule according to generic formula (IV):

$$L-P^1-S-[S-P^2-S]_n-S-P^3-L \qquad \text{formula (IV)}$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), (AA)$_x$, or [(AA)$_x$]$_z$ if such components are used as a linker between $P^1$ and $P^2$ or $P^3$ and $P^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), $(AA)_x$, or $[(AA)_x]_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (IV) above (the brackets are omitted for better readability), wherein any of S, $P^1$ and $P^3$ are as defined herein, typically represent a situation, wherein one-SH-moiety of hydrophilic polymers $P^1$ and $P^3$ was condensed with one —SH-moiety of component $P^2$ of generic formula (IV) above, wherein both sulphurs of these —SH-moieties form a disulfide bond —S—S— as defined herein in formula (IV). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers P' and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methathesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

The complexed artificial nucleic acid in the inventive (pharmaceutical) composition or vaccine, is preferably prepared according to a first step by complexing the at least one artificial with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed artificial nucleic acid after complexing the artificial nucleic acid. Accordingly, the ratio of the at least one artificial nucleic acid and the cationic or polycationic compound and/or the polymeric carrier in the component of the complexed at least one artificial nucleic acid is typically selected in a range that the at least one artificial nucleic acid is entirely complexed and no free cationic or polycationic compound or polymeric carrier or only a negligibly small amount thereof remains in the composition.

The inventive composition comprising at least one artificial nucleic acid according to the invention may be provided in liquid and or in dry (e.g. lyophilized) form. In a preferred embodiment, the inventive artificial nucleic acid or the inventive composition is provided in lyophilized form. The inventive artificial nucleic acid and the inventive composition thus provide a possibility to store (irrespective of the ambient temperature and also without cooling) an artificial nucleic acid and a composition suitable for vaccination against Zika virus and related disorders. Preferably, the at least one lyophilized artificial nucleic acid is reconstituted in a suitable buffer, advantageously based on an aqueous carrier, e.g. Ringer-Lactate solution, prior to use, such as administration to a subject.

In a further aspect, the invention concerns a vaccine comprising the artificial nucleic acid as described herein or the inventive composition comprising at least one artificial nucleic acid according to the invention. Therein, the at least one artificial nucleic acid preferably elicits an adaptive immune response upon administration to a subject.

In a preferred embodiment, the inventive vaccine comprises the artificial nucleic acid as described herein or the inventive composition comprising at least one artificial nucleic acid according to the invention and a pharmaceutically acceptable carrier. Accordingly, the inventive vaccine is based on the same components as the inventive composition comprising at least one artificial nucleic acid according to the invention as defined above. Insofar, it may be referred to the above disclosure defining the inventive composition.

As with the composition according to the present invention, the entities of the vaccine may be provided in liquid and or in dry (e.g. lyophlized) form. They may contain further components, in particular further components allowing for its pharmaceutical use. The inventive vaccine or the inventive composition may, e.g., additionally contain a pharmaceutically acceptable carrier and/or further auxiliary substances and additives and/or adjuvants.

The inventive vaccine or composition typically comprises a safe and effective amount of the inventive artificial nucleic acid as defined herein. As used herein, "safe and effective amount" means an amount of the artificial nucleic acid of the composition or the vaccine as defined above, that is sufficient to significantly induce an immune response against a Zika virus protein. At the same time, however, a "safe and effective amount" is small enough to avoid serious side effects that is to say to permit a sensible relationship between advantage and risk. The determination of these limits typically lies within the scope of sensible medical judgment. In relation to the inventive vaccine or composition, the expression "safe and effective amount" preferably means an amount of the artificial nucleic acid that is suitable for stimulating the adaptive immune system in such a manner that no excessive or damaging immune reactions are achieved but, preferably, also no such immune reactions below a measurable level. Such a "safe and effective amount" of the artificial nucleic acid of the composition or vaccine as defined above may furthermore be selected in dependence of the type of artificial nucleic acid, e.g. monocistronic, bi- or even multicistronic mRNA, since a bi- or even multicistronic mRNA may lead to a significantly higher expression of the encoded polypeptide(s) than use of an equal amount of a monocistronic mRNA. A "safe and effective amount" of the artificial nucleic acid of the composition or vaccine as defined above may furthermore vary in connection with the particular objective of the treatment and also with the age and physical condition of the patient to be treated, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the artificial nucleic acid of the composition, vaccine or kit of parts according to the invention is provided in lyophilized form. Preferably, the lyophilized artificial nucleic acid is reconstituted in a suitable buffer, advantageously based on an aqueous carrier, prior to administration, e.g. Ringer-Lactate solution, which is preferred, Ringer solution, a phosphate buffer solution.

According to a preferred embodiment, the buffer suitable for injection may be used as a carrier in the inventive vaccine or composition or for resuspending the inventive vaccine or the inventive composition. Such a buffer suitable for injection may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

The choice of a pharmaceutically acceptable carrier is determined, in principle, by the manner, in which the inventive vaccine or the inventive composition is administered. The inventive vaccine or composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the inventive vaccine or the inventive composition may be administered by an intradermal, subcutaneous, or intramuscular route, preferably by injection, which may be needle-free and/or needle injection. Compositions/vaccines are therefore preferably formulated in liquid or solid form. The suitable amount of the inventive vaccine or composition to be administered can be determined by routine experiments with animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

According to another embodiment, the inventive (pharmaceutical) composition or the inventive vaccine may comprise an adjuvant. An adjuvant may be used, for example, in order to enhance the immunostimulatory properties of the vaccine or composition. In this context, an adjuvant may be understood as any compound, which is suitable to support administration and delivery of the vaccine or composition according to the invention. Furthermore, such an adjuvant may, without being bound thereto, initiate or increase an immune response of the innate immune system, i.e. a non-specific immune response. In other words, when administered, the vaccine or composition according to the invention typically initiates an adaptive immune response due to the at least one polypeptide encoded by the artificial nucleic acid contained in the inventive vaccine or composition. Additionally, the vaccine or composition according to the invention may generate an (supportive) innate immune response due to addition of an adjuvant as defined herein to the vaccine or composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL' (1-alpha,25-dihydroxy-vitamin D3); calcium phosphate gel; CAP$^7$M (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1 beta; interleukin-2; interleukin-7; interleukin-12; ISCOMS™; ISCOPREP 7.0.3.™; liposomes; LOXORIBINE™ (7-allyl-8-oxoguanosine); LT oral adjuvant (E. coli labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6, 10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, 1C31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred are aluminium salts, such as aluminium phosphate (AlPO$_4$) or aluminium hydroxide (Al (OH)$_3$) and adjuvant compounds based thereon. More preferably, an aluminium salt, such as AlPO$_4$ (e.g. Adju-Phos) may be used in combination with the inventive artificial nucleic acid in its free form or with the inventive artificial nucleic acid complexed with a cationic or polycationic compound as described herein. Most preferably, an aluminium salt, such as AlPO$_4$ (e.g. Adju-Phos) may be used as adjuvant in combination with the inventive artificial nucleic acid in its free form.

Suitable adjuvants may also be selected from cationic or polycationic compounds, preferably as described herein, wherein the adjuvant is preferably prepared upon complexing the at least one artificial nucleic acid of the inventive composition or vaccine with the cationic or polycationic compound. Association or complexing the artificial nucleic acid with cationic or polycationic compounds as defined herein preferably provides adjuvant properties and confers a stabilizing effect to the artificial nucleic acid.

The ratio of the artificial nucleic acid to the cationic or polycationic compound in the adjuvant component may be calculated on the basis of the nitrogen/phosphate ratio (N/P-ratio) of the entire artificial nucleic acid complex, i.e. the ratio of positively charged (nitrogen) atoms of the cationic or polycationic compound to the negatively charged phosphate atoms of the nucleic acids. For example, 1 µg RNA typically contains about 3 nmol phosphate residues, provided the RNA exhibits a statistical distribution of bases. Additionally, 1 µg peptide typically contains about x nmol nitrogen residues, dependent on the molecular weight and the number of basic amino acids. When exemplarily calculated for $(Arg)_9$ (molecular weight 1424 g/mol, 9 nitrogen atoms), 1 µg $(Arg)_9$ contains about 700 pmol $(Arg)_9$ and thus 700×9=6300 pmol basic amino acids=6.3 nmol nitrogen atoms. For a mass ratio of about 1:1 RNA/(Arg)9 an N/P ratio of about 2 can be calculated. When exemplarily calcuated for protamine (molecular weight about 4250 g/mol, 21 nitrogen atoms, when protamine from salmon is used) with a mass ratio of about 2:1 with 2 µg RNA, 6 nmol phosphate are to be calulated for the RNA; 1 µg protamine contains about 235 pmol protamine molecues and thus 235×21=4935 pmol basic nitrogen atoms=4.9 nmol nitrogen atoms. For a mass ratio of about 2:1 RNA/protamine an NIP ratio of about 0.81 can be calculated. For a mass ratio of about 8:1 RNA/protamine an NIP ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of nucleic acid:peptide in the complex, and most preferably in the range of about 0.7-1.5.

In a preferred embodiment, the inventive vaccine or the inventive composition is obtained in two separate steps in order to obtain both, an efficient immunostimulatory effect and efficient translation of the artificial nucleic acid according to the invention. Therein, a so called "adjuvant component" is prepared by complexing—in a first step—a nucleic acid, preferably an RNA, of the adjuvant component with a cationic or polycationic compound in a specific ratio to form a stable complex. In this context, it is important, that no free cationic or polycationic compound or only a neglibly small amount remains in the adjuvant component after complexing the nucleic acid. Accordingly, the ratio of the nucleic acid, preferably an RNA, and the cationic or polycationic compound in the adjuvant component is typically selected in a range that the artificial nucleic acid is entirely complexed and no free cationic or polycationic compound or only a neglectably small amount remains in the composition. Preferably the ratio of the adjuvant component, i.e. the ratio of the artificial nucleic acid to the cationic or polycationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the artificial nucleic acid, preferably an mRNA, is added in a second step to the complexed nucleic acid, preferably an RNA, of the adjuvant component in order to form the (immunostimulatory) composition of the invention. Therein, the artificial nucleic acid is added as free nucleic acid, i.e. nucleic acid, which is not complexed by other compounds. Prior to addition, the free artificial nucleic acid is not complexed and will preferably not undergo any detectable or significant complexation reaction upon the addition of the adjuvant component. This is due to the strong binding of the cationic or polycationic compound to the above described artificial nucleic acid in the adjuvant component. In other words, when the artificial nucleic acid according to the invention, is added to the "adjuvant component", preferably no free or substantially no free cationic or polycationic compound is present, which may form a complex with the free artificial nucleic acid. Accordingly, an efficient translation of the free artificial nucleic acid of the inventive vaccine or composition is possible in vivo. Therein, the free artificial nucleic acid may occur, for example, as a mono-, di-, or multicistronic nucleic acid, i.e. an artificial nucleic acid which carries the coding sequences of one or more polypeptides. Such coding sequences in a di-, or even multicistronic nucleic acid may be separated by at least one IRES sequence, e.g. as defined herein.

In a particularly preferred embodiment, the free artificial nucleic acid, which is comprised in the inventive vaccine or composition, may be identical or different to the RNA of the adjuvant component of the inventive composition, depending on the specific requirements of therapy. Even more preferably, the artificial nucleic acid, preferably an mRNA, which is comprised in the inventive vaccine or composition, is identical to the RNA of the adjuvant component of the inventive vaccine or composition.

In a particularly preferred embodiment, the composition comprises the artificial nucleic acid, preferably an mRNA, wherein said artificial nucleic acid is present in the composition partially as free nucleic acid and partially as complexed nucleic acid. Preferably, the artificial nucleic acid, preferably an mRNA, is complexed as described above and the same artificial nucleic acid is then added as free nucleic acid, wherein preferably the compound, which is used for complexing the artificial nucleic acid is not present in free form in the composition at the moment of addition of the free nucleic acid component.

The ratio of the first component (i.e. the adjuvant component comprising or consisting of artificial nucleic acid complexed with a cationic or polycationic compound) and the second component (i.e. the free nucleic acid) may be selected in the inventive composition according to the specific requirements of a particular therapy. Typically, the ratio of the nucleic acid, preferably an RNA, in the adjuvant component and the at least one free artificial nucleic acid, preferably an mRNA, (artificial nucleic acid, preferably mRNA in the adjuvant component:free RNA) of the inventive composition is selected such that a significant stimulation of the innate immune system is elicited due to the adjuvant component. In parallel, the ratio is selected such that a significant amount of the at least one free artificial nucleic acid, preferably an mRNA, can be provided in vivo leading to an efficient translation and concentration of the expressed protein in vivo, e.g. the at least one encoded polypeptide as defined herein. Preferably, the ratio of the mRNA in the adjuvant component:free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component:free mRNA in the inventive composition is selected from a ratio of about 1:1 (w/w).

Additionally or alternatively, the ratio of the first component (i.e. the adjuvant component comprising or consisting of artificial nucleic acid complexed with a cationic or polycationic compound) and the second component (i.e. free artificial nucleic acid) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of artificial nucleic acid, preferably mRNA, complexed with a cationic or polycationic compound) and the second component (i.e. free artificial nucleic acid, preferably mRNA) may also be selected in the inventive composition on the basis of the molar ratio of both nucleic acids to each other, i.e. the nucleic acid of the adjuvant component, being complexed with a cationic or polycationic compound and the free nucleic acid of the second component. Typically, the molar ratio of the nucleic acid of the adjuvant component to the free nucleic acid of the second component may be selected such, that the molar ratio suffices the above (w/w) and/or N/P-definitions. More preferably, the molar ratio of the nucleic acid, preferably an mRNA, of the adjuvant component to the free nucleic acid, preferably an mRNA, of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the artificial nucleic acid, preferably an mRNA, of the adjuvant component to the free nucleic acid, preferably an mRNA, of the second component may be selected e.g. from a range of about 0.01:1 to 1:0.01. Most preferably, the molar ratio of the nucleic acid of the adjuvant component to the free nucleic acid of the second component may be selected e.g. from a molar ratio of about 1:1. Any of the above definitions with regard to (w/w) and/or N/P ratio may also apply.

Suitable adjuvants may furthermore be selected from nucleic acids having the formula (V): $G_lX_mG_n$, wherein: G is guanosine, uracil or an analogue of guanosine or uracil; X is guanosine, uracil, adenosine, thymidine, cytosine or an analogue of the above-mentioned nucleotides; l is an integer from 1 to 40, wherein when l=1 G is guanosine or an analogue thereof, when l>1 at least 50% of the nucleotides are guanosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 G is guanosine or an analogue thereof, when n>1 at least 50% of the nucleotides are guanosine or an analogue thereof.

Other suitable adjuvants may furthermore be selected from nucleic acids having the formula (VI): $C_lX_mC_n$, wherein: C is cytosine, uracil or an analogue of cytosine or uracil; X is guanosine, uracil, adenosine, thymidine, cytosine or an analogue of the above-mentioned nucleotides; l is an integer from 1 to 40, wherein when l=1 C is cytosine or an analogue thereof, when l>1 at least 50% of the nucleotides are cytosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 C is cytosine or an analogue thereof, when n>1 at least 50% of the nucleotides are cytosine or an analogue thereof.

The inventive vaccine or composition can additionally contain one or more auxiliary substances in order to further increase the immunogenicity. A synergistic action of the artificial nucleic acid of the composition or vaccine as defined herein and of an auxiliary substance, which may be optionally be co-formulated (or separately formulated) with the inventive vaccine or composition as described above, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Preferably, the above compounds are formulated and administered separately from the above composition or vaccine (of the invention) containing the artificial nucleic acid according to the invention.

In a further aspect, the present invention concerns a polypeptide encoded by the inventive artificial nucleic acid as described herein, or a fragment of said polypeptide.

According to a further aspect, the present invention also provides a polypeptide comprising or consisting of at least one protein selected from the group consisting of Zika virus premembrane protein (prM), Zika virus pr protein (pr), Zika virus membrane protein (M), Zika virus envelope protein (E) and a Zika virus non-structural protein, or a fragment or variant of any of these proteins, and at least one amino acid sequence selected from the group consisting of:
a) an amino acid sequence derived from a C-terminal fragment from mature Zika virus capsid protein (C), or a variant thereof, wherein the C-terminal fragment preferably comprises or consists of 3 to 20 amino acid residues,
b) an amino acid sequence derived from a signal sequence of Zika virus capsid protein (C), or a fragment or variant thereof, and
c) an amino acid sequence derived from an N-terminal fragment from mature Zika virus non-structural protein (NS1), or a variant thereof, wherein the N-terminal fragment preferably comprises or consists of 3 to 20 amino acid residues.

Alternatively, the inventive polypeptide comprises or consists of at least one protein selected from the group consisting of Zika virus premembrane protein (prM), Zika virus pr protein (pr), Zika virus membrane protein (M), Zika virus envelope protein (E) and a Zika virus non-structural protein, or a fragment or variant of any of these proteins, and at least one amino acid sequence selected from the group consisting of:
a) an amino acid sequence derived from a C-terminal fragment from mature Zika virus capsid protein (C), or a variant thereof, wherein the C-terminal fragment preferably comprises or consists of 3 to 20 amino acid residues,
b) an amino acid sequence derived from a C-terminal fragment, or a variant thereof, of Zika virus capsid protein (C) as present in Zikavirus polyprotein before cleavage, and
c) an amino acid sequence derived from an N-terminal fragment from mature Zika virus non-structural protein (NS1), or a variant thereof, wherein the N-terminal fragment preferably comprises or consists of 3 to 20 amino acid residues.

With respect to the features of the inventive polypeptide, reference is made to the description provided herein concerning the at least one polypeptide encoded by the artificial nucleic acid according to the invention. In particular, the at least one protein selected from the group consisting of Zika virus premembrane protein (prM), Zika virus pr protein (pr), Zika virus membrane protein (M), Zika virus envelope protein (E) and a Zika virus non-structural protein, or a fragment or variant of any of these proteins, as comprised in the inventive polypeptide, is preferably characterized by the corresponding features of the at least one polypeptide encoded by the artificial nucleic acid according to the invention as described herein. Moreover, the amino acid sequences a), b) and c) of the inventive polypeptide are preferably as described herein with respect to the corresponding features of the at least one polypeptide encoded by the artificial nucleic acid according to the invention.

In a certain embodiment, the inventive polyprotein preferably comprises or consists of an amino acid sequence according to any one of SEQ ID NO: 1 to 3, 9, 18 to 20, 26, 35 to 37 or 43.

According to a preferred embodiment, the inventive polypeptide comprises or consists of, preferably in this order from N-terminus to C-terminus,
Zika virus premembrane protein (prM) or Zika virus membrane protein (M); and
Zika virus envelope protein (E);
or a fragment or variant of any of these proteins; and
at least one amino acid sequence selected from the group consisting of:
a) an amino acid sequence derived from a C-terminal fragment from mature Zika virus capsid protein (C), or a variant thereof, wherein the C-terminal fragment preferably comprises or consists of 3 to 20 amino acid residues,
b) an amino acid sequence derived from a signal sequence of Zika virus capsid protein (C), or a fragment or variant thereof, or an amino acid sequence derived from a C-terminal fragment, or a variant thereof, of Zika virus capsid protein (C) as present in Zikavirus polyprotein before cleavage, and
c) an amino acid sequence derived from an N-terminal fragment from mature Zika virus non-structural protein (NS1), or a variant thereof, wherein the N-terminal fragment preferably comprises or consists of 3 to 20 amino acid residues.

More preferably, the inventive polypeptide comprises or consists of, preferably in this order from N-terminus to C-terminus:
a) an amino acid sequence derived from a C-terminal fragment from mature Zika virus capsid protein (C), or a variant thereof, wherein the C-terminal fragment preferably comprises or consists of 3 to 20 amino acid residues,
b) an amino acid sequence derived from a signal sequence of Zika virus capsid protein (C), or a fragment or variant thereof, or an amino acid sequence derived from a C-terminal fragment, or a variant thereof, of Zika virus capsid protein (C) as present in Zikavirus polyprotein before cleavage, preferably as described herein c) Zika virus premembrane protein (prM) or Zika virus membrane protein (M), or a fragment or variant of any of these proteins,
d) Zika virus envelope protein (E), or a fragment or variant thereof, and
e) an amino acid sequence derived from an N-terminal fragment from mature Zika virus non-structural protein (NS1), or a variant thereof, wherein the N-terminal fragment preferably comprises or consists of 3 to 20 amino acid residues.

In a preferred embodiment, the inventive polypeptide does not comprise an amino acid sequence from Zika virus capsid protein (C) or from Zika virus non-structural protein 1 (NS1) distinct from the following amino acid sequences:
a) an amino acid sequence derived from a C-terminal fragment from mature Zika virus capsid protein (C), or a variant thereof, wherein the C-terminal fragment preferably comprises or consists of 3 to 20 amino acid residues,
b) an amino acid sequence derived from a signal sequence of Zika virus capsid protein (C), or a fragment or variant thereof, or
an amino acid sequence derived from a C-terminal fragment, or a variant thereof, of Zika virus capsid protein (C) as present in Zikavirus polyprotein before cleavage, preferably as described herein, and
c) an amino acid sequence derived from an N-terminal fragment from mature Zika virus non-structural protein (NS1), or a variant thereof, wherein the N-terminal fragment preferably comprises or consists of 3 to 20 amino acid residues.

Preferably, the amino acid sequence derived from a signal sequence of Zika virus capsid protein (C) comprises or consists of an amino acid sequence according to any one of SEQ ID NO: 343 to 345, or a fragment or variant of any of these sequences.

The amino acid sequence derived from a C-terminal fragment from mature Zika virus capsid protein (C) preferably comprises or consists of an amino acid sequence according to any one of SEQ ID NO: 361 to 363, or a fragment or variant thereof.

More preferably, the amino acid sequence derived from an N-terminal fragment from mature Zika virus non-structural protein (NS1) comprises or consists of an amino acid sequence according to any one of SEQ ID NO: 379 to 381, or a fragment or variant thereof.

According to a preferred embodiment, the polypeptide of the present invention comprises or consists of an amino acid sequence selected from the group consisting of the amino acid sequences according to any one of SEQ ID NO: 16, 33, 50, 421 to 423 or 445 to 447, or a fragment or variant of any of these sequences.

According to a further aspect, the present invention provides a polypeptide comprising or consisting of
a) a fragment of Zika virus envelope protein (E), or a variant of said fragment, and
b) a fragment of Zika virus premembrane protein (prM) or a fragment of Zika virus membrane protein (M), or a variant of any of these fragments.

Therein, the fragment of Zika virus premembrane protein (prM) or the fragment of Zika virus membrane protein (M) preferably comprises or consists of an amino acid sequence corresponding to amino acid residues 273 to 290 of a Zika virus polyprotein, or a fragment or variant thereof. More preferably, the fragment of Zika virus premembrane protein (prM) or the fragment of Zika virus membrane protein (M) preferably comprises or consists of an amino acid sequence corresponding to a continuous amino acid sequence beginning at amino acid residue 270, preferably at amino acid residue 273, and ending at the C-terminus of mature Zika virus membrane protein (M), preferably derived from a strain as described herein.

In a particularly preferred embodiment, the inventive polypeptide comprises or consists of an amino acid sequence corresponding to amino acid residues 273 to 723 or 273 to 719, of a Zika virus polyprotein, or a fragment or variant thereof. According to one embodiment, the inventive polypeptide comprises or consists of an amino acid sequence corresponding to amino acid residues 273 to 723, or a fragment or variant thereof, of a Zika virus polyprotein derived from Zika virus strain ZikaSPH2015-Brazil or Z1106033-Suriname. Alternatively, the inventive polypeptide comprises or consists of an amino acid sequence corresponding to amino acid residues 273 to 719, or a fragment or variant thereof, of a Zika virus polyprotein derived from Zika virus strain MR766.

It is further preferred, that the inventive polypeptide comprises or consists of an amino acid sequence corresponding to any one of SEQ ID NO: 17, 34, 51, 492 or 494, or a fragment or variant of any of these sequences.

According to a preferred embodiment, the inventive polypeptides as described herein comprises a molecular tag, wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

In a further aspect, the present invention provides a composition comprising at least one of the inventive polypeptides as described herein. In a preferred embodiment, the inventive composition comprises one type of polypeptide as described herein. Alternatively, the inventive composition may comprise at least two different inventive polypeptides as described herein.

Preferably, the inventive composition comprises or consists of at least one of the inventive polypeptides described herein and a pharmaceutically acceptable carrier. In this context, the pharmaceutically acceptable carrier as well as optional further components of the composition are preferably as described herein with respect to the inventive composition comprising at least one inventive artificial nucleic acid.

In a further aspect, the invention concerns a vaccine comprising the inventive composition comprising at least one of the polypeptides according to the invention. Therein, the at least one of the inventive polypeptides preferably elicits an adaptive immune response upon administration to a subject. More preferably, the vaccine according to the invention comprising at least one of the inventive polypeptides or the inventive composition comprising at least one of the polypeptides according to the invention is preferably a vaccine as described herein. Reference is made to the respective description herein.

As used herein, the term 'inventive composition' may refer to the inventive composition comprising at least one artificial nucleic acid according to the invention as well as to the inventive composition comprising at least one of the polypeptides according to the invention. Likewise, the term 'inventive vaccine', as used in this context, may refer to an inventive vaccine, which is based on the inventive artificial nucleic acid, i.e. which comprises at least one artificial nucleic acid according to the invention or which comprises the inventive composition comprising said artificial nucleic acid, as well as to an inventive vaccine, which is based on the inventive polypeptide(s), i.e. which comprises at least one polypeptide according to the invention or which comprises the inventive composition comprising said at least one polypeptide according to the invention.

According to another embodiment, the present invention also provides kits, particularly kits of parts, comprising the artificial nucleic acid according to the invention, the inventive composition comprising at least one artificial nucleic acid according to the invention, the inventive polypeptides as described herein, the inventive composition comprising at least one inventive polypeptide or the inventive vaccine as described herein, optionally a liquid vehicle for solubilising and optionally technical instructions with information on the administration and dosage of the artificial nucleic acid according as described herein, the inventive composition comprising at least one artificial nucleic acid according to the invention, the inventive polypeptides as described herein, the inventive composition comprising at least one inventive polypeptide or the inventive vaccine. The technical instructions may contain information about administration and dosage. Such kits, preferably kits of parts, may be applied e.g. for any of the applications or uses mentioned herein, preferably for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of a Zika virus infection or diseases or disorders related thereto. The kits may also be applied for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of Zika virus infection or diseases or disorders related thereto, wherein the artificial nucleic acid according as described herein, the inventive composition comprising at least one artificial nucleic acid according to the invention, the inventive polypeptides as described herein, the inventive composition comprising at least one inventive polypeptide or the inventive vaccine may induce or enhance an immune response in a mammal as defined above. Preferably, the artificial nucleic acid according as described herein, the inventive composition comprising at least one artificial nucleic acid according to the invention, or the inventive vaccine is provided in a separate part of the kit, wherein the the artificial nucleic acid according as described herein, the inventive composition comprising at least one artificial nucleic acid according to the invention, or the inventive vaccine are preferably lyophilised. More preferably, the kit further contains as a part a vehicle for solubilising the artificial nucleic acid according as described herein, the inventive composition comprising at least one artificial nucleic acid according to the invention, or the inventive vaccine, the vehicle preferably being Ringer-lactate solution. Any of the above kits may be used in a treatment or prophylaxis as defined above. More preferably, any of the above kits may be used as a vaccine, preferably a vaccine against Zika virus infection or a related disease or disorder.

The present invention furthermore provides several applications and uses of the artificial nucleic acid according to the invention, the inventive composition comprising at least one artificial nucleic acid according to the invention, the inventive polypeptides as described herein, the inventive composition comprising at least one inventive polypeptide or the inventive vaccine or of kits comprising same. In particular, the inventive (pharmaceutical) composition(s) or the inventive vaccine may be used for human and also for veterinary medical purposes, preferably for human medical purposes, as a pharmaceutical composition in general or as a vaccine.

In a further aspect, the invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for use in a method of prophylactic (pre-exposure prophylaxis or post-exposure prophylaxis) and/or therapeutic treatment of Zika virus infections (Zika). Consequently, in a further aspect, the present invention is directed to the first medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts as defined herein as a medicament. Particularly, the invention provides the use of an artificial nucleic acid comprising at least one coding region encoding at least one polypeptide comprising at least one Zika virus protein as defined herein, or a fragment or variant thereof as described herein for the preparation of a medicament.

According to another aspect, the present invention is directed to the second medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for the treatment of an infection with Zika virus or a disorder related to an infection with Zika virus as defined herein. Particularly, the artificial nucleic acid comprising at least one coding region encoding at least one polypeptide comprising at least one Zika virus protein as defined herein, or a fragment or variant thereof as described herein to be used in a method as said above is an artificial nucleic acid formulated together with a pharmaceutically acceptable vehicle and an optionally additional adjuvant and an optionally additional further component as defined herein.

The invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for medical use, in particular for the treatment of an infection with Zika virus or a disorder related to an infection with Zika virus, wherein preferably an infection with Zika virus may involve any Zika virus strain. More preferably, the Zika virus infection is caused by a Zika virus strain, which is selected from the group consisting of ZikaSPH2015-Brazil, Z1106033-Suriname and MR766-Uganda or from the group consisting of ZikaSPH2015-Brazil, Z1106033-Suriname, MR766-Uganda and Natal RGN.

As used herein, 'a disorder related to a Zika virus infection' may preferably comprise a complication of Zika virus infection, such as teratogenic effects or neurological complications. For example, 'a disorder related to a Zika virus infection' may be teratogenic effects that lead, for instance, to congenital malformations, such as microencephaly in newborns. Moreover, 'a disorder related to a Zika virus infection' may also comprise neurological diseases or disorders, such as Guillain-Barré-Syndrome, preferably a neurological complication of Zika virus infection. In a preferred embodiment, the inventive composition or vaccine is thus used for treatment or prophylaxis, preferably prophylaxis, of complications associated with a Zika virus infection.

The inventive composition or the inventive vaccine, in particular the inventive composition comprising at least one artificial nucleic acid according to the invention, the inventive polypeptides as described herein or the inventive composition comprising at least one inventive polypeptide, can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, vaccines may be administered by an intradermal, subcutaneous, or intramuscular route. Inventive vaccines are therefore preferably formulated in liquid (or sometimes in solid) form. Preferably, the inventive vaccine may be administered by conventional needle injection or needle-free jet injection. In a preferred embodiment the inventive vaccine or composition may be administered by jet injection as defined herein, preferably intramuscularly or intradermally, more preferably intradermally.

In a preferred embodiment, a single dose of the inventive artificial nucleic acid, composition or vaccine comprises a specific amount of the artificial nucleic acid according to the invention. Preferably, the inventive artificial nucleic acid is provided in an amount of at least 40 µg per dose, preferably in an amount of from 40 to 700 µg per dose, more preferably in an amount of from 80 to 400 µg per dose. More specifically, in the case of intradermal injection, which is preferably carried out by using a conventional needle, the amount of the inventive artificial nucleic acid comprised in a single dose is typically at least 200 µg, preferably from 200 µg to 1.000 µg, more preferably from 300 µg to 850 µg, even more preferably from 300 µg to 700 µg. In the case of intradermal injection, which is preferably carried out via jet injection (e.g. using a Tropis device), the amount of the inventive artificial nucleic acid comprised in a single dose is typically at least 80 µg, preferably from 80 µg to 700 µg, more preferably from 80 µg to 400 µg. Moreover, in the case of intramuscular injection, which is preferably carried out by using a conventional needle or via jet injection, the amount of the inventive artificial nucleic acid comprised in a single dose is typically at least 80 µg, preferably from 80 µg to 1.000 µg, more preferably from 80 µg to 850 µg, even more preferably from 80 µg to 700 µg.

The immunization protocol for the treatment or prophylaxis of a Zika virus infection, i.e the immunization of a subject against Zika virus, typically comprises a series of single doses or dosages of the inventive composition or the inventive vaccine. A single dosage, as used herein, refers to the initial/first dose, a second dose or any further doses, respectively, which are preferably administered in order to "boost" the immune reaction.

According to a preferred embodiment, the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts is provided for use in treatment or prophylaxis, preferably treatment or prophylaxis of a Zika virus infection or a related disorder, wherein the treatment or prophylaxis comprises the administration of a further active pharmaceutical ingredient. More preferably, in the case of the inventive vaccine or composition, which is based on the inventive artificial nucleic acid, a polypeptide may be co-administered as a further active pharmaceutical ingredient. For example, at least one Zika virus protein as described herein, or a fragment or variant thereof, may be co-administered in order to induce or enhance an immune response. Likewise, in the case of the inventive vaccine or composition, which is based on the inventive polypeptide as described herein, an artificial nucleic acid as described herein may be co-administered as a further active pharmaceutical ingredient. For example, an artificial nucleic acid as described herein encoding at least one polypeptide as described herein may be co-administered in order to induce or enhance an immune response.

A further component of the inventive vaccine or composition may be an immunotherapeutic agent that can be selected from immunoglobulins, preferably IgGs, monoclonal or polyclonal antibodies, polyclonal serum or sera, etc, most preferably immunoglobulins directed against a Zika virus. Preferably, such a further immunotherapeutic agent may be provided as a peptide/protein or may be encoded by a nucleic acid, preferably by a DNA or an RNA, more preferably an mRNA. Such an immunotherapeutic agent allows providing passive vaccination additional to active vaccination triggered by the inventive artificial nucleic acid or by the inventive polypeptide.

In a further aspect the invention provides a method of treating or preventing a disorder, wherein the disorder is preferably an infection with Zika virus or a disorder related to an infection with Zika virus, wherein the method comprises administering to a subject in need thereof the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts.

In particular, such a method may preferably comprise the steps of:
a) providing the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts;
b) applying or administering the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts to a tissue or an organism;
c) optionally administering immune globuline against Zika virus.

According to a further aspect, the present invention also provides a method for expression of at least one polypeptide comprising at least one Zika virus, or a fragment or variant thereof, wherein the method preferably comprises the following steps:
a) providing the inventive artificial nucleic acid comprising at least one coding region encoding at least one polypeptide comprising at least one Zika virus, or a fragment or variant thereof, preferably as defined herein, or a composition comprising said artificial nucleic acid; and b) applying or administering the inventive artificial nucleic acid or the inventive composition comprising said artificial nucleic acid to an expression system, e.g. to a cell-free expression system, a cell (e.g. an expression host cell or a somatic cell), a tissue or an organism.

The method may be applied for laboratory, for research, for diagnostic, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, e.g. in naked or complexed form or as a (pharmaceutical) composition or vaccine as described herein, preferably via transfection or by using any of the administration modes as described herein. The method may be carried out in vitro, in vivo or ex vivo. The method may furthermore be carried out in the context of the treatment of a specific disease, particularly in the treatment of infectious diseases, preferably Zika virus infection or a related disorder as defined herein.

In this context, in vitro is defined herein as transfection or transduction of the inventive artificial nucleic acid as defined herein or of the inventive composition or vaccine as defined herein into cells in culture outside of an organism; in vivo is defined herein as transfection or transduction of the inventive artificial nucleic acid or of the inventive composition or vaccine into cells by application of the inventive mRNA or of the inventive composition to the whole organism or individual and ex vivo is defined herein as transfection or transduction of the inventive artificial nucleic acid or of the inventive composition or vaccine into cells outside of an organism or individual and subsequent application of the transfected cells to the organism or individual.

Likewise, according to another aspect, the present invention also provides the use of the inventive artificial nucleic acid as defined herein or of the inventive composition or vaccine as defined herein, preferably for diagnostic or therapeutic purposes, for expression of an encoded antigenic peptide or protein, e.g. by applying or administering the inventive artificial nucleic acid as defined herein or of the inventive composition or vaccine as defined herein, e.g. to a cell-free expression system, a cell (e.g. an expression host cell or a somatic cell), a tissue or an organism. The use may be applied for a (diagnostic) laboratory, for research, for diagnostics, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, preferably in naked form or complexed form, or as a (pharmaceutical) composition or vaccine as described herein, preferably via transfection or by using any of the administration modes as described herein. The use may be carried out in vitro, in vivo or ex vivo. The use may furthermore be carried out in the context of the treatment of a specific disease, particularly in the treatment of Zika virus infection or a related disorder.

In a particularly preferred embodiment, the invention provides the artificial nucleic acid, the inventive composition or the inventive vaccine for use as defined herein, preferably for use as a medicament, for use in treatment or prophylaxis, preferably treatment or prophylaxis of a Zika virus infection or a related disorder, or for use as a vaccine.

According to a preferred embodiment, the at least one polypeptide encoded by the artificial nucleic acid according to the invention applied in an use as defined herein, preferably for use as vaccine, comprises or consists of an amino acid sequence according to any one of SEQ ID NO: 1 to 51, 343 to 345, 361 to 363, 379 to 381, 397 to 399, 409 to 411, 421 to 423, 433 to 435, 445 to 447, 491 to 496 or 499 to 501, or a fragment or variant of any of these sequences, preferably an amino acid sequence according to any one of SEQ ID NO: 8, 16, 17, 26, 33, 34, 43, 50, 51, 397 to 399, 409 to 411, 421 to 423, 433 to 435, 446 to 447 or 491 to 496, or a fragment or variant of any of these sequences, more preferably an amino acid sequence according to any one of SEQ ID NO: 16, 17, 33, 34, 50, 51 or 491 to 496, most preferably an amino acid sequence according to any one of SEQ ID NO: 16, 33, 50, 491, 493 or 495, or a fragment or variant thereof. More preferably, the at least one polypeptide encoded by the artificial nucleic acid according to the invention applied in an use as defined herein, preferably for use as vaccine, comprises or consists of an amino acid sequence, which is at least 80% identical to any one of the sequences above.

According to a further preferred embodiment, the at least one coding region of the artificial nucleic acid according to the invention applied in an use as defined herein, preferably for use as vaccine, comprises or consists of a nucleic acid sequence according to any one of SEQ ID NO: 52 to 232, 346 to 360, 364 to 378, 382 to 396, 400 to 408, 412 to 420, 424 to 432, 436 to 444, 448 to 456 or 502 to 518, or a fragment or variant of any of these sequences, preferably a nucleic acid according to any one of SEQ ID NO: 67 to 69, 85 to 87, 103 to 105, 122 to 125, 141 to 144, 160 to 175, 191 to 194, 210 to 213, 229 to 232, 400 to 408, 412 to 420, 424 to 432, 436 to 444 or 448 to 456, or a fragment or variant of any of these sequences, more preferably a nucleic acid sequence according to any one of SEQ ID NO: 122 to 125, 141 to 144, 160 to 175, 191 to 194, 210 to 213, 229 to 232, 403 to 408, 415 to 420, 427 to 432, 439 to 444 or 451 to 456, or a fragment or variant of any of these sequences, even more preferably a nucleic acid sequence according to SEQ ID NO: 124, 125, 143, 144, 162, 163, 165, 167, 169, 171, 173 or 175, most preferably a nucleic acid sequence according to any one of SEQ ID NO: 122, 123, 141, 142, 160, 161, 164, 166, 168, 170, 172 or 174, or a fragment or variant of any of these sequences. More preferably, the at least one coding region of the artificial nucleic acid according to the invention applied in an use as defined herein, preferably for use as vaccine, comprises or consists of a nucleic acid sequence, which is at least 80% identical to any one of the sequences above.

In a particularly preferred embodiment, the artificial nucleic acid according to the invention applied in an use as defined herein, preferably for use as vaccine, comprises or consists of a nucleic acid sequence according to any one of SEQ ID NO: 233 to 342, or a fragment or variant of any of these sequences, preferably a nucleic acid according to any one of SEQ ID NO: 235, 239, 243, 247, 249, 252, 254, 257, 261, 263, 265, 267, 269 or 271, or a fragment or variant of any of these sequences, more preferably a nucleic acid sequence according to SEQ ID NO: 290 or 302, or a fragment or variant of any of these sequences, even more preferably a nucleic acid sequence according to SEQ ID NO: 249 or 254, or a fragment or variant of any of these sequences, even more preferably a nucleic acid sequence according to SEQ ID NO: 235, 239, 243, 247, 252, 257, 261, 263, 265, 267, 269, 271, 290 or 302, or a fragment or variant of any of these sequences, most preferably a nucleic acid sequence according to SEQ ID NO: 235, 239, 243, 247, 252, 257, 261, 263, 265, 267, 269 or 271, or a fragment or variant of any of these sequences. More preferably, the artificial nucleic acid according to the invention applied in an use as defined herein, preferably for use as vaccine, comprises or consists of a nucleic acid sequence, which is at least 80% identical to any one of the sequences above.

Certain aspects of the present invention are further summarized by the following items:

1. Artificial nucleic acid comprising at least one coding region encoding at least one polypeptide comprising
   at least one protein selected from the group consisting of Zika virus capsid protein (C), Zika virus premembrane protein (prM), Zika virus pr protein (pr), Zika virus membrane protein (M), Zika virus envelope protein (E) and a Zika virus non-structural protein, or a fragment or variant of any of these proteins.
2. The artificial nucleic acid according to item 1, wherein the at least one encoded polypeptide comprises Zika virus envelope protein (E), or a fragment or variant thereof.
3. The artificial nucleic acid according to item 1 or 2, wherein the at least one encoded polypeptide comprises Zika virus premembrane protein (prM) or Zika virus membrane protein (M), or a fragment or variant of any of these proteins.
4. The artificial nucleic acid according to any one of items 1 to 3, wherein the at least one encoded polypeptide comprises, preferably in this order from N-terminus to C-terminus,
   Zika virus premembrane protein (prM) or Zika virus membrane protein (M); and
   Zika virus envelope protein (E);
   or a fragment or variant of any of these proteins.
5. The artificial nucleic acid according to any one of items 1 to 4, wherein the at least one encoded polypeptide comprises Zika virus capsid protein (C) or a fragment or a variant thereof.
6. The artificial nucleic acid according to any one of items 1 to 5, wherein the Zika virus non-structural protein is selected from the group consisting of NS1, NS2A, NS2B, NS3, NS4A, NS4B and NS5.
7. The artificial nucleic acid according to any one of items 1 to 6, wherein the at least one encoded polypeptide comprises at least one of the amino acid sequences according to any one of SEQ ID NO: 2 to 7, 9 to 15, 19 to 24, 26 to 32, 36 to 41 or 43 to 49, or a fragment or variant of any of these sequences.
8. The artificial nucleic acid according to any one of items 1 to 7, wherein the at least one coding sequence comprises at least one of the nucleic acid sequences according to any one of SEQ ID NO: 53 to 58, 60 to 66, 70 to 76, 78 to 84, 89 to 94 or 96 to 102, or a fragment or variant of any of these sequences.
9. The artificial nucleic acid according to any one of items 1 to 8, wherein the artificial nucleic acid is monocistronic, bicistronic or multicistronic.
10. The artificial nucleic acid according to any one of items 1 to 9, wherein the artificial nucleic acid is monocistronic and wherein the coding region encodes a polypeptide comprising at least two different Zika virus proteins according to any one of items 1 to 6, or a fragment or variant thereof.
11. The artificial nucleic acid according to any one of items 1 to 9, wherein the artificial nucleic acid is bi- or multicistronic and comprises at least two coding regions, wherein the at least two coding regions encode at least two polypeptides, wherein each of the at least two polypeptides comprises at least one different Zika virus protein according to any one of items 1 to 6, or a fragment or variant of any one of these proteins.
12. The artificial nucleic acid according to any one of items 1 to 11, wherein the at least one encoded polypeptide comprises at least one amino acid sequence derived from a signal sequence, or a fragment or variant thereof.
13. The artificial nucleic acid according to item 12, wherein the at least one amino acid sequence derived from a signal sequence comprises an amino acid sequence that is bound by signal recognition particle (SRP).
14. The artificial nucleic acid according to item 12, wherein the at least one amino acid sequence derived from a signal sequence comprises an amino acid sequence that is recognized by signal peptide peptidase (SPP), by a viral protease and/or by furin or a furin-like protease.
15. The artificial nucleic acid according to item 14, wherein the viral protease comprises Zika virus non-structural protein 3 (NS3) and, optionally, Zika virus non-structural protein 2B (NS2B).
16. The artificial nucleic acid according to any one of items 12 to 15, wherein the at least one amino acid sequence derived from a signal sequence is derived from a signal sequence of a secretory protein or from a signal sequence of a membrane protein.
17. The artificial nucleic acid according to any one of item 12 to 16, wherein the at least one amino acid sequence derived from a signal sequence targets the at least one encoded polypeptide to the endoplasmic reticulum (ER) or to the ER membrane.
18. The artificial nucleic acid according to any one of items 12 to 17, wherein the at least one amino acid sequence derived from a signal sequence is derived from a signal sequence of Zika virus capsid protein (C).
19. The artificial nucleic acid according to any one of items 12 to 18, wherein the at least one amino acid sequence derived from a signal sequence is derived from an amino acid consisting of amino acid residues 105 to 122 of a Zika virus polyprotein, or a fragment or variant thereof.
20. The artificial nucleic acid according to any one of items 12 to 19, wherein the at least one amino acid sequence derived from a signal sequence comprises an amino acid sequence according to any one of SEQ ID NO: 343 to 345, or a fragment or variant of any of these sequences.
21. The artificial nucleic acid according to item 20, wherein the at least one amino acid sequence derived from a signal sequence is encoded by a nucleic acid sequence corresponding to any one of SEQ ID NO: 346 to 348, or a fragment or variant of any of these sequences.
22. The artificial nucleic acid according to any one of items 1 to 21, wherein the at least one encoded polypeptide comprises at least one amino acid sequence derived from a C-terminal fragment from mature Zika virus capsid protein (C), or a variant thereof, wherein the C-terminal fragment consists of 3 to 20 amino acid residues.
23. The artificial nucleic acid according to any one of items 1 to 21, wherein the at least one encoded polypeptide comprises at least one amino acid sequence derived from an amino acid sequence consisting of amino acid residues 93 to 104 of a Zika virus polyprotein, or a fragment or variant thereof.
24. The artificial nucleic acid according to item 22 or 23, wherein the at least one encoded protein comprises at least one amino acid sequence derived from an amino acid sequence corresponding to any one of SEQ ID NO: 361 to 363, or a fragment or variant thereof.

25. The artificial nucleic acid according to any one of items 22 to 24, wherein the at least one coding region comprises at least one nucleic acid sequence derived from a nucleic acid sequence corresponding to any one of SEQ ID NO: 364 to 366, or a fragment of any of these sequences.
26. The artificial nucleic acid according to any one of items 1 to 24, wherein the at least one encoded polypeptide does not comprise an amino acid sequence that is derived from an amino acid sequence corresponding to amino acid residues 1 to 92 of a Zika virus polyprotein.
27. The artificial nucleic acid according to any one of items 1 to 26, wherein the at least one encoded polypeptide comprises at least one amino acid sequence derived from an N-terminal fragment from mature Zika virus non-structural protein (NS1), or a variant of said fragment, wherein the N-terminal fragment consists of 3 to 20 amino acid residues.
28. The artificial nucleic acid according to any one of items 1 to 26, wherein the at least one encoded polypeptide comprises at least one amino acid sequence derived from an amino acid sequence consisting of amino acid residues 795 to 804 or 791 to 800 of a Zika virus polypeptide, or a fragment or variant thereof.
29. The artificial nucleic acid according to item 27 or 28, wherein the at least one encoded polypeptide comprises at least one amino acid sequence derived from an amino acid sequence corresponding to any one of SEQ ID NO: 379 to 381, or a fragment or variant thereof.
30. The artificial nucleic acid according to any one of items 27 to 29, wherein the at least one coding region comprises at least one nucleic acid sequence derived from a nucleic acid sequence corresponding to any one of SEQ ID NO: 382 to 384, or a fragment or variant of any of these sequences.
31. The artificial nucleic acid according to any one of items 1 to 30, wherein the at least one encoded polypeptide does not comprise an amino acid sequence that is derived from an amino acid sequence corresponding to amino acid residues 814 to 1146 or 810 to 1142 of a Zika virus polyprotein.
32. The artificial nucleic acid according to any one of items 1 to 31, wherein the at least one encoded polypeptide comprises at least one of the amino acid sequences according to SEQ ID NO: 16, 33 or 50, or a fragment or variant of any of these sequences.
33. The artificial nucleic acid according to any one of items 1 to 32, wherein the at least one coding sequence comprises at least one of the nucleic acid sequences according to SEQ ID NO: 67, 68, 85, 86, 103 or 104, or a fragment or variant of any of these sequences.
34. The artificial nucleic acid according to any one of items 1 to 33, wherein the artificial nucleic acid is an RNA, preferably an mRNA.
35. The artificial nucleic acid according to any one of items 1 to 34, wherein the artificial nucleic acid comprises a 5'-CAP structure.
36. The artificial nucleic acid according to any one of items 1 to 35, wherein the G/C content of the at least one coding region is increased compared to the GIC content of the corresponding coding sequence of the wild-type mRNA, wherein the encoded amino acid sequence is preferably not modified compared to the amino acid sequence encoded by the corresponding wild-type mRNA.
37. The artificial nucleic acid according to item 36, wherein the at least one coding region comprises at least one nucleic acid sequence according to any one of SEQ ID NO: 107 to 232, 349 to 360, 367 to 378, 385 to 396, 403 to 408, 415 to 420, 427 to 432, 439 to 444, 451 to 456 or 505 to 516, or a fragment or variant of any of these sequences.
38. The artificial nucleic acid according to any one of items 1 to 37, wherein the at least one coding region comprises a nucleic acid sequence, which is codon-optimized.
39. The artificial nucleic acid according to item 38, wherein the at least one coding region comprises at least one nucleic acid sequence according to SEQ ID NO: 164 to 232, 352 to 360, 370 to 378, 388 to 396, 406 to 408, 418 to 420, 430 to 432, 442 to 444, 454 to 456 or 508 to 516, or a fragment or variant of any of these sequences.
40. The artificial nucleic acid according to any one of items 1 to 39, wherein the artificial nucleic acid comprises at least one histone stem-loop.
41. The artificial nucleic acid according to item 40, wherein the at least one histone stem-loop comprises a nucleic acid sequence according to the following formulae (I) or (II):

(stem-loop sequence without stem bordering elements):

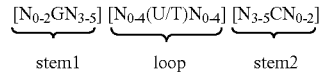

formula (I)

(stem-loop sequence with stem bordering elements):

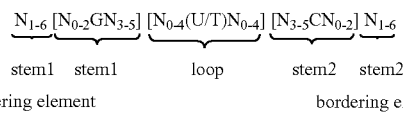

formula (II)

wherein:
stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;
stem1 [$N_{0-2}$ $GN_{3-5}$] is reverse complementary or partially reverse complementary with element stem2, and is a consecutive sequence between of 5 to 7 nucleotides;
  wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;
  wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and
  wherein G is guanosine or an analogue thereof, and may be optionally replaced by a cytidine or an analogue thereof, provided that its complementary nucleotide cytidine in stem2 is replaced by guanosine;
loop sequence [$N_{0-4}$ (U/T)N0-4] is located between elements stem1 and stem2, and is a consecutive sequence of 3 to 5 nucleotides, more preferably of 4 nucleotides;
  wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally stem2 [N$_{3-5}$CN$_{0-2}$] is reverse complementary or partially reverse complementary with element stem1, and is a consecutive sequence between of 5 to 7 nucleotides;

wherein N$_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein N$_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; and wherein C is cytidine or an analogue thereof, and may be optionally replaced by a guanosine or an analogue thereof provided that its complementary nucleotide guanosine in stem1 is replaced by cytidine;

wherein stem1 and stem2 are capable of base pairing with each other forming a reverse complementary sequence, wherein base pairing may occur between stem1 and stem2, or forming a partially reverse complementary sequence, wherein an incomplete base pairing may occur between stem1 and stem2.

42. The artificial nucleic acid according to item 41, wherein the at least one histone stem-loop comprises a nucleic acid sequence according to the following formulae (Ia) or (IIa):

formula (Ia)

(stem-loop sequence without stem bordering elements):

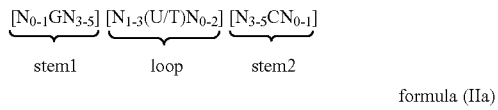

formula (IIa)

(stem-loop sequence with stem bordering elements):

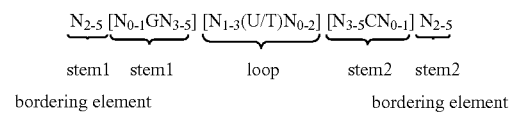

43. The artificial nucleic acid according to any one of items 40 to 42, wherein the at least one histone stem loop comprises a nucleic acid sequence according to SEQ ID NO: 487 or 488, or a fragment or variant thereof.

44. The artificial nucleic acid molecule according to any one of items 1 to 43, wherein the artificial nucleic acid comprises an untranslated region (UTR).

45. The artificial nucleic acid according to item 44, wherein the artificial nucleic acid comprises a 3'-UTR.

46. The artificial nucleic acid according to item 45, wherein the 3'-UTR comprises at least one heterologous 3'-UTR element.

47. The artificial nucleic acid according to item 45 or 46, wherein the 3'-UTR comprises a poly(A) sequence and/or a poly(C) sequence.

48. The artificial nucleic acid according to item 47, wherein the poly(A) sequence comprises 10 to 200, 10 to 100, 40 to 80 or 50 to 70 adenosine nucleotides, and/or the poly(C) sequence comprises 10 to 200, 10 to 100, 20 to 70, 20 to 60 or 10 to 40 cytosine nucleotides.

49. The artificial nucleic acid according to any one of items 46 to 48, wherein the at least one heterologous 3'-UTR element comprises a nucleic acid sequence derived from a 3'-UTR of a gene, which preferably encodes a stable mRNA, or from a homolog, a fragment or a variant of said gene.

50. The artificial nucleic acid according to item 49, wherein the at least one heterologous 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene, or from a homolog, a fragment or a variant thereof.

51. The artificial nucleic acid according to item 50, wherein the at least one heterologous 3'-UTR element comprises a nucleic acid sequence derived from a 3'UTR of an α-globin gene, preferably comprising the corresponding RNA sequence of the nucleic acid sequence according to SEQ ID NO: 483 or 484, a homolog, a fragment, or a variant thereof.

52. The artificial nucleic acid according to item 50, wherein the at least one heterologous 3'-UTR element comprises a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a fragment or variant thereof.

53. The artificial nucleic acid according to item 52, wherein the at least one heterologous 3'-UTR element comprises a nucleic acid sequence according to SEQ ID NO. 475, 476, 485 or 486, or a homolog, a fragment or a variant thereof.

54. The artificial nucleic acid according to any one of items 44 to 53, wherein the artificial nucleic acid comprises a 5'-UTR.

55. The artificial nucleic acid sequence according to item 54, wherein the 5'-UTR comprises at least one heterologous 5'-UTR element.

56. The artificial nucleic acid according to item 55, wherein the at least one heterologous 5'-UTR element comprises a nucleic acid sequence, which is derived from the 5'-UTR of a TOP gene, preferably from a corresponding RNA sequence, or a homolog, a fragment, or a variant thereof, preferably lacking the 5'TOP motif.

57. The artificial nucleic acid according to item 56, wherein the at least one heterologous 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the 5'TOP motif.

58. The artificial nucleic acid according to item 56 or 57, wherein the at least one heterologous 5'-UTR element comprises a nucleic acid sequence, which is derived from a 5'-UTR of a TOP gene encoding a ribosomal Large protein (RPL), preferably RPL32 or RPL35A, or from a gene selected from the group consisting of HSD17B4, ATP5A1, AIG1, ASAH1, COX6C or ABCB7 (MDR), or from a homolog, a fragment or variant of any one of these genes, preferably lacking the STOP motif.

59. The artificial nucleic acid according to any one of items 56 to 58, wherein the at least one heterologous 5'-UTR element comprises a nucleic acid sequence according to SEQ ID NO. 457 to 474, or a homolog, a fragment or a variant thereof.

60. The artificial nucleic acid according to any one of items 1 to 59 comprising, preferably in 5' to 3' direction, the following elements:
    a) a 5'-CAP structure, preferably m7GpppN,
    b) a coding region encoding at least one protein comprising at least one Zika virus protein as described herein, or a fragment or variant thereof,
    c) a poly(A) tail, preferably consisting of 10 to 200, 10 to 100, 40 to 80 or 50 to 70 adenosine nucleotides,
    d) a poly(C) tail, preferably consisting of 10 to 200, 10 to 100, 20 to 70, 20 to 60 or 10 to 40 cytosine nucleotides, and
    e) a histone stem-loop, preferably comprising the RNA sequence according to SEQ ID NO. 487 or 488.

61. The artificial nucleic acid according to any one of items 1 to 60 comprising, preferably in 5' to 3' direction, the following elements:
    a) a 5'-CAP structure, preferably m7GpppN,
    b) a coding region encoding at least one protein comprising at least one Zika virus protein as described herein, or a fragment or variant thereof,
    c) a 3'-UTR element comprising a nucleic acid sequence, which is derived from an α-globin gene, preferably comprising the corresponding RNA sequence of the nucleic acid sequence according to SEQ ID NO. 483 or 484, or a homolog, a fragment or a variant thereof,
    d) a poly(A) tail, preferably consisting of 10 to 200, 10 to 100, 40 to 80 or 50 to 70 adenosine nucleotides,
    e) a poly(C) tail, preferably consisting of 10 to 200, 10 to 100, 20 to 70, 20 to 60 or 10 to 40 cytosine nucleotides, and
    f) a histone stem-loop, preferably comprising the RNA sequence according to SEQ ID NO. 487 or 488.

62. The artificial nucleic acid according to item 61, wherein the artificial nucleic acid comprises a nucleic acid sequence according to any one of SEQ ID NO: 233 to 245, or a fragment or variant of any of these sequences.

63. The artificial nucleic acid according to item 61, wherein the coding region comprises a modified nucleic acid sequence.

64. The artificial nucleic acid according to item 63, wherein the artificial nucleic acid comprises a nucleic acid sequence according to any one of SEQ ID NO: 246 to 287, or a fragment or variant of any of these sequences.

65. The artificial nucleic acid according to any one of items 1 to 60 comprising, preferably in 5' to 3' direction, the following elements:
    a) a 5'-CAP structure, preferably m7GpppN,
    b) a 5'-UTR element, which comprises or consists of a nucleic acid sequence, which is derived from the 5'-UTR of a TOP gene, preferably comprising a nucleic acid sequence according to SEQ ID NO. 457 or 458, or a homolog, a fragment or a variant thereof,
    c) a coding region encoding at least one protein comprising at least one Zika virus protein as described herein, or a fragment or variant thereof,
    d) a 3'-UTR element comprising a nucleic acid sequence, which is derived from an albumin gene, preferably comprising the corresponding RNA sequence of the nucleic acid sequence according to SEQ ID NO. 485 or 486, or a homolog, a fragment or a variant thereof,
    e) a poly(A) tail, preferably consisting of 10 to 200, 10 to 100, 40 to 80 or 50 to 70 adenosine nucleotides,
    f) a poly(C) tail, preferably consisting of 10 to 200, 10 to 100, 20 to 70, 20 to 60 or 10 to 40 cytosine nucleotides, and
    g) a histone stem-loop, preferably comprising the RNA sequence according to SEQ ID NO. 487 or 488.

66. The artificial nucleic acid according to item 65, wherein the artificial nucleic acid comprises a nucleic acid sequence according to any one of SEQ ID NO: 288 to 300, or a fragment or variant of any of these sequences.

67. The artificial nucleic acid according to item 65, wherein the coding region comprises a modified nucleic acid sequence.

68. The artificial nucleic acid according to item 67, wherein the artificial nucleic acid comprises a nucleic acid sequence according to any one of SEQ ID NO: 301 to 342, or a fragment or variant of any of these sequences.

69. The artificial nucleic acid according to any one of items 1 to 68, wherein the at least one coding region comprises a nucleic acid sequence encoding a molecular tag and wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

70. Composition comprising at least one artificial nucleic acid as defined by any one of items 1 to 69 and a pharmaceutically acceptable carrier.

71. The composition according to item 70, wherein the composition comprises at least two artificial nucleic acids as defined by any one of items 1 to 69, wherein each of the at least two artificial nucleic acids comprises at least one coding region encoding at least one protein comprising a different one of the Zika virus proteins according to any of items 1 to 6, or a fragment or a variant of any one of these proteins.

72. The composition according to item 70 or 71, wherein the composition comprises at least two artificial nucleic acids as defined by any one of items 1 to 69, wherein each of the at least two artificial nucleic acids comprises at least one coding region encoding at least one protein comprising at least two different Zika virus proteins according to any of items 1 to 6, or a fragment or a variant of any one of these proteins.

73. The composition according to any one of items 70 to 72, wherein the at least one artificial nucleic acid is complexed at least partially with a cationic or polycationic compound and/or a polymeric carrier, preferably a cationic protein or peptide.

74. The composition according to item 73, wherein the ratio of complexed nucleic acid to free nucleic acid is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w).

75. Polypeptide encoded by the artificial nucleic acid according to any one of items 1 to 69.

76. Polypeptide comprising at least one protein selected from the group consisting of Zika virus premembrane protein (prM), Zika virus membrane protein (M), Zika virus envelope protein (E) and a Zika virus non-structural protein, or a fragment or variant of any of these proteins, and at least one amino acid sequence selected from the group consisting of:
- a) an amino acid sequence derived from a C-terminal fragment from mature Zika virus capsid protein (C), or a variant thereof, wherein the C-terminal fragment consists of 3 to 20 amino acid residues, b) an amino acid sequence derived from a signal sequence of Zika virus capsid protein (C), or a fragment or variant thereof, and c) an amino acid sequence derived from an N-terminal fragment from mature Zika virus non-structural protein (NS1), or a variant thereof, wherein the N-terminal fragment consists of 3 to 20 amino acid residues.

77. The polypeptide according to item 76 comprising, preferably in this order from N-terminus to C-terminus, Zika virus premembrane protein (prM) or Zika virus membrane protein (M); and Zika virus envelope protein (E);

or a fragment or variant of any of these proteins.

78. The polypeptide according to item 76 or 77 comprising, preferably in this order from N-terminus to C-terminus:

an amino acid sequence derived from a C-terminal fragment from mature Zika virus capsid protein (C), or a variant thereof, wherein the C-terminal fragment consists of 3 to 20 amino acid residues, an amino acid sequence derived from a signal sequence of Zika virus capsid protein (C), or a fragment or variant thereof, Zika virus premembrane protein (prM) or Zika virus membrane protein (M), or a fragment or variant of any of these proteins, Zika virus envelope protein (E), or a fragment or variant thereof, and an amino acid sequence derived from an N-terminal fragment from mature Zika virus non-structural protein (NS1), or a variant thereof, wherein the N-terminal fragment consists of 3 to 20 amino acid residues.

79. The polypeptide according to any one of items 76 to 78, wherein the polypeptide does preferably not comprise an amino acid sequence from Zika virus capsid protein (C) or from Zika virus non-structural protein 1 (NS1) distinct from the amino acid sequences defined under a), b) and c) in item 76.

80. The polypeptide according to any one of items 76 to 79, wherein the amino acid sequence derived from a signal sequence of Zika virus capsid protein (C) comprises an amino acid sequence according to any one of SEQ ID NO: 343 to 345, or a fragment or variant of any of these sequences.

81. The polypeptide according to any one of items 76 to 80, wherein the amino acid sequence derived from a C-terminal fragment from mature Zika virus capsid protein (C) comprises an amino acid sequence according to any one of SEQ ID NO: 361 to 363, or a fragment or variant thereof.

82. The polypeptide according to any one of items 76 to 81, wherein the amino acid sequence derived from an N-terminal fragment from mature Zika virus non-structural protein (NS1) comprises an amino acid sequence according to any one of SEQ ID NO: 379 to 381, or a fragment or variant thereof.

83. The polypeptide according to any one of items 76 to 82 comprising an amino acid sequence according to any one of SEQ ID NO: 16, 33, 50, 421 to 423 or 445 to 447, or a fragment or variant of any of these sequences.

84. Polypeptide comprising a) a fragment of Zika virus envelope protein (E), or a variant of said fragment, and b) a fragment of Zika virus premembrane protein (prM) or a fragment of Zika virus membrane protein (M), or a variant of any of these fragments.

85. The polypeptide according to item 84, wherein the fragment of Zika virus premembrane protein (prM) or the fragment of Zika virus membrane protein (M) comprises of an amino acid sequence corresponding to amino acid residues 273 to 290 of a Zika virus polyprotein, or a fragment or variant thereof.

86. The polypeptide according to item 84 or 85 comprising an amino acid sequence corresponding to amino acid residues 273 to 723 or 273 to 719 of a Zika virus polyprotein, or a fragment or variant thereof.

87. The polypeptide according to any one of items 84 to 86 comprising an an amino acid sequence corresponding to any one of SEQ ID NO: 17, 34, 51, 492 or 494, or a fragment or variant of any of these sequences.

88. The polypeptide according to any one of items 76 to 83 or 84 to 87 comprising a molecular tag, wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

89. Composition comprising the polypeptide according to any one of items 75, 76 to 83 or 84 to 88, and a pharmaceutically acceptable carrier.

90. Vaccine comprising the artificial nucleic acid according to any one of items 1 to 69, the composition according to any one of items 70 to 74, the polypeptide according to any one of items 75, 76 to 83 or 84 to 88, and/or the composition according to item 89.

91. The vaccine according to item 90, wherein the artificial nucleic acid according to any one of items 1 to 69, the composition according to any one of items 70 to 74, the polypeptide according to any one of items 75, 76 to 83 or 84 to 88, or the composition according to item 89 elicits an adaptive immune response.

92. The vaccine according to item 90 or 91, wherein the vaccine further comprises a pharmaceutically acceptable carrier.

93. The vaccine according to any one of items 90 to 92 further comprising an adjuvant.

94. Kit or kit of parts comprising the artificial nucleic acid according to any one of items 1 to 69, the composition according to any one of items 70 to 74, the polypeptide according to any one of items 75, 76 to 83 or 84 to 88, the composition according to item 89 or the vaccine according to any one of items 90 to 93, optionally a liquid vehicle for solubilising, and optionally technical instructions providing information on administration and dosage of the components.

95. The kit or kit of parts according to item 94 comprising Ringer lactate solution.

96. The artificial nucleic acid according to any one of items 1 to 69, the composition according to any one of items 70 to 74, the polypeptide according to any one of items 75, 76 to 83 or 84 to 88, the composition according to item 89, the vaccine according to any one of items 90 to 93, or the kit or kit of parts according to item 94 or 95 for use as a medicament.

97. The artificial nucleic acid according to any one of items 1 to 69, the composition according to any one of items 70 to 74, the polypeptide according to any one of items 75, 76 to 83 or 84 to 88, the composition according to item 89, the vaccine according to any one of items 90 to 93, or the kit or kit of parts according to item 94 or 95 for use in the treatment or prophylaxis of an infection with Zika virus or a disorder related to an infection with Zika virus.

98. The artificial nucleic acid according to any one of items 1 to 69, the composition according to any one of items 70 to 74, the polypeptide according to any one of items 75, 76 to 83 or 84 to 88, the composition according to item 89, the vaccine according to any one of items 90 to 93, or the kit or kit of parts according to item 94 or 95 for use according to item 96 or 97, wherein the artificial nucleic acid, the composition, the vaccine or the active component of the kit or kit of parts is administered by injection, preferably by needle-less injection, more preferably by jet injection.

99. The artificial nucleic acid according to any one of items 1 to 69, the composition according to any one of items 70 to 74, the polypeptide according to any one of items 75, 76 to 83 or 84 to 88, the composition according to item 89, the vaccine according to any one of items 90 to 93, or the kit or kit of parts according to item 94 or 95 for use according to any one of items 96 to 99, wherein the treatment or prophylaxis comprises the administration of a further active pharmaceutical ingredient.

100. Method of treating or preventing a disorder, wherein the method comprises administering to a subject in need thereof the artificial nucleic acid according to any one of items 1 to 69, the composition according to any one of items 70 to 74, the polypeptide according to any one of items 75, 76 to 83 or 84 to 88, the composition according to item 89, the vaccine according to any one of items 90 to 93, or the kit or kit of parts according to item 94 or 95.

101. The method according to item 100, wherein the disorder is an infection with Zika virus or a disorder related to an infection with Zika virus.

EXAMPLES

Figure 1:
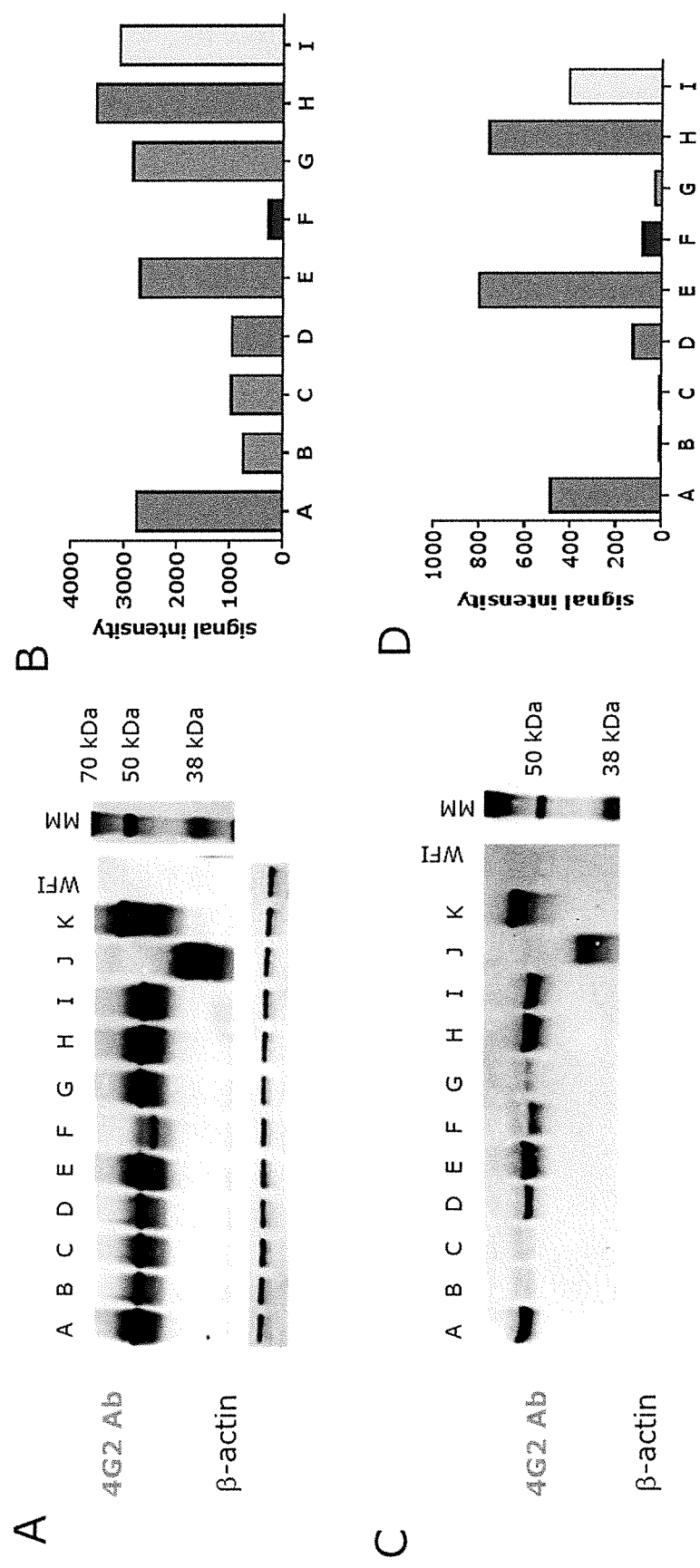
FIG. 1 shows that transfection of HeLa cells with mRNAs coding for Zika virus prME leads to the expression of the encoded Zika virus proteins. Constructs used for cell transfections are formulated Zika virus mRNA constructs (see Table 8), and a two irrelevant mRNA controls. Panel A and B: cell lysates; Panel C and D: VLP preparations. A detailed description of the experiment is provided in the example section, Example 2.

The Examples shown in the following are merely illustrative and shall describe the present invention in a further way. These Examples shall not be construed to limit the present invention thereto.

Example 1: Preparation of mRNA for In Vitro and In Vivo Experiments

1. Preparation of DNA and mRNA Constructs

For the present examples, DNA sequences encoding Zika virus proteins, derived from three different Zika virus strains, were prepared and used for subsequent RNA in vitro transcription reactions. The prepared RNA constructs are listed in Table 7.

Most DNA sequences were prepared by modifying the wild type encoding DNA sequences by introducing a GC-optimized sequence for stabilization, using three different in silico algorithms that increase the GC content of the respective coding sequence (indicated as "GC op 1", "GC op 2", "GC opt 3" in Table 7). Some DNA sequences were used as a wild type coding sequence, without altering the GC content (indicated as "wt" in Table 7).

Moreover, sequences were introduced into a pUC19 derived vector and modified to comprise stabilizing sequences derived from alpha-globin-3'-UTR, a stretch of 30 cytosines, a histone-stem-loop structure, and a stretch of 64 adenosines at the 3'-terminal end (poly-A-tail), indicated as "design 1" in Table 7. Other sequences were introduced into a pUC19 derived vector to comprise stabilizing sequences derived from 32L4 5' UTR ribosomal 5'TOP UTR and 3'UTR derived from albumin 7, a stretch of 30 cytosines, a histone-stem-loop structure, and a stretch of 64 adenosines at the 3'-terminal end (poly-A-tail), indicated as "design 2" in Table 7.

The obtained plasmid DNA constructs were transformed and propagated in bacteria (*Escherichia coli*) using common protocols known in the art.

TABLE 7 mRNA and protein constructs

| RNA ID | Construct description | Zika virus strain | RNA design | SEQ ID NO RNA: | SEQ ID NO Protein: |
|---|---|---|---|---|---|
| R1 | X-SS$_C$-prME-XX | Brazil SPH2015 | design 1; wt | 235 | 16 533 556 636 |
| R2 | X- SS$_C$-prME-XX | Suriname Z1106033 | design 1; wt | 239 | 33 534 637 |
| R3 | X-SS$_C$-prME-XX | Uganda MR766 | design 1; wt | 243 | 50 535 638 |
| R4 | X-SS$_C$-prME-XX | Brazil SPH2015 | design 1; GC opt 1 | 247 3293 | 16 533 556 636 |
| R5 | SS$_M$-SolE$_{del\_TM}$ | Brazil SPH2015 | design 1; GC opt 1 | 249 3301 | 17 541 766 |
| R6 | X-SS$_C$-prME-XX | Suriname Z1106033 | design 1; GC opt 1 | 252 3294 | 33 534 637 |
| R7 | SS$_M$-SolE$_{del\_TM}$ | Suriname Z1106033 | design 1; GC opt 1 | 254 3302 | 34 542 767 |
| R8 | X-SS$_C$-prME-XX | Uganda MR766 | design 1; GC opt 1 | 257 3295 | 50 535 638 |
| R9 | X-SS$_C$-prME-XX | Brazil SPH2015 | design 1; GC opt 2 | 261 | 16 533 556 636 |
| R10 | X-SS$_C$-prME-XX | Suriname Z1106033 | design 1; GC opt 2 | 263 | 33 534 637 |
| R11 | X-SS$_C$-prME-XX | Uganda MR766 | design 1; GC opt 2 | 265 | 50 535 638 |
| R12 | X-SS$_C$-prME-XX | Brazil SPH2015 | design 1; GC opt 3 | 267 | 16 533 556 636 |
| R13 | X-SS$_C$-prME-XX | Suriname Z1106033 | design 1; GC opt 3 | 269 | 33 534 637 |
| R14 | X-SS$_C$-prME-XX | Uganda MR766 | design 1; GC opt 3 | 271 | 50 535 638 |
| R15 | X-SS$_C$-prME-XX | Brazil SPH2015 | design 2; wt | 290 5225 | 16 533 556 636 |
| R16 | X-SS$_C$-prME-XX | Suriname Z1106033 | design 2; wt | 294 5226 | 33 534 637 |
| R17 | X-SS$_C$-prME-XX | Uganda MR766 | design 2; wt | 298 5227 | 50 535 638 |
| R18 | X-SS$_C$-prME-XX | Brazil SPH2015 | design 2; GC opt 1 | 302 5501 | 16 533 556 636 |
| R19 | SS$_M$-SolE$_{del\_TM}$ | Brazil SPH2015 | design 2; GC opt 1 | 304 5509 | 17 541 766 |
| R20 | X-SS$_C$-prME-XX | Suriname Z1106033 | design 2; GC opt 1 | 307 5502 | 33 534 637 |
| R21 | SS$_M$-SolE$_{del\_TM}$ | Suriname Z1106033 | design 2; GC opt 1 | 309 5510 | 34 542 767 |
| R22 | X-SS$_C$-prME-XX | Uganda MR 766 | design 2; GC opt 1 | 312 5503 | 50 535 638 |
| R23 | X-SS$_C$-prME-XX | Brazil SPH2015 | design 2; GC opt 2 | 316 | 16 533 556 636 |
| R24 | X-SS$_C$-prME-XX | Suriname Z1106033 | design 2; GC opt 2 | 318 | 33 534 637 |
| R25 | X-SS$_C$-prME-XX | Uganda MR766 | design 2; GC opt 2 | 320 | 50 535 638 |
| R26 | X-SS$_C$-prME-XX | Brazil SPH2015 | design 2; GC opt 3 | 322 | 16 533 556 636 |
| R27 | X-SS$_C$-prME-XX | Suriname Z1106033 | design 2; GC opt 3 | 324 | 33 534 637 |
| R28 | X-SS$_C$-prME-XX | Uganda MR766 | design 2; GC opt 3 | 326 | 50 535 638 |
| R29 | SS$_S$-prME | Brazil SPH2015 | Design 1; GC opt1 | 3297 | 537 702 |
| R30 | SS$_S$-prME | Brazil SPH2015 | Design 1; wt | 3021 | 537 702 |
| R31 | SS$_S$-prME | Brazil SPH2015 | Design 2; GC opt1 | 5505 | 537 702 |
| R32 | SS$_S$-prME | Natal RGN | Design 1; GC opt1 | 3300 | 540 702 |
| R33 | SS$_S$-prME$_{F398S}$ (Env fusion loop mutation) | Brazil SPH2015 | Design 2; GC opt1 | 5513 | 545 |
| R34 | SS$_S$-prME$_{N444Q}$ (Env glycosylation site mutation) | Brazil SPH2015 | Design 2; GC opt1 | 5517 | 549 |
| R35 | SS$_S$-prME$_{del\_stem\_TM-JEV}$ | Brazil SPH2015 | Design 2; GC opt1 | 5520 | 552 |
| R36 | SS$_s$-prME | Natal RGN | Design 2; GC opt1 | 5508 | 540 702 |
| R37 | SS$_{MHCII}$-prME | Natal RGN | Design 2; GC opt1 | 10364 | 9644 |
| R38 | SS$_{MHCII}$-prME | Natal RGN | Design 2; GC opt1; m1Ψ | 10364 | 9644 |
| R39 | SS$_{MHCII}$-prME | Brazil SPH2015 | Design 2; GC opt1 | 10361 | 9647 |
| R40 | SS$_{MHCII}$-prME | Brazil SPH2015 | Design 2; GC opt1; m1Ψ | 10361 | 9647 |
| R41 | SS$_{JEV}$-prME$_{del\_stem\_TM-JEV}$ | Brazil SPH2015 | Design 2; GC opt1 | 10381 | 9661 |
| R42 | SS$_{JEV}$-ME | Brazil SPH2015 | Design 2; GC opt1 | 10397 | 9677 |
| R43 | SS$_{JEV}$-prME$_{del\_stem\_TM-JEV}$ | Natal RGN | Design 2; GC opt1 | 10384 | 9664 |
| R44 | SS$_{IgE}$-prME | Brazil SPH2015 | Design 2; GC opt1 | 10365 | 9645 |
| R45 | SS$_{IgE}$-prME$_{del\_stem\_TM-JEV}$ | Brazil SPH2015 | Design 2; GC opt1 | 10377 | 9657 |

The abbreviations used for the constructs in Table 7 refer to the following amino acid residues (aa) in Zika virus polyprotein, heterologous elements and RNA design:

X: N-terminal overhang (derived from the Capsid protein)
  aa 93-104 (ZikaSPH2015-Brazil, Z1106033-Suriname, MR766-Uganda, Natal RGN);
$SS_C$: signal sequence derived from the Capsid protein
  aa 105-122 (ZikaSPH2015-Brazil, Z1106033-Suriname, MR766-Uganda, Natal RGN);
$SS_M$: signal sequence derived from the M protein
  aa 216-290 (ZikaSPH2015-Brazil, Z1106033-Suriname, MR766-Uganda, Natal RGN);
$SS_S$: signal sequence derived from SSC with shorter N-terminus
  aa 108-122 (ZikaSPH2015-Brazil, Z1106033-Suriname, MR766-Uganda, Natal RGN);
$SS_{MHCII}$: heterologous signal peptide derived from MHCII
$SS_{JEV}$: heterologous signal peptide derived from Japanese encephalitis virus
$SS_{IgE}$: heterologous signal peptide derived from Japanese encephalitis virus
prME: aa 123-794 (ZikaSPH2015-Brazil, Z1106033-Suriname, Natal RGN);
  as 123-790 (MR766-Uganda);
ME: as 216-794 (ZikaSPH2015-Brazil, Z1106033-Suriname, Natal RGN)
  aa 216-790 (MR766-Uganda)
XX: aa 795-804 (ZikaSPH2015-Brazil, Z1106033-Suriname, Natal RGN);
  aa 791-800 (MR766-Uganda)
JEV: stem region of the Japanese encephalitis virus E protein
  aa 400-500
SolE: soluble E protein, with deletion of the transmembrane domain
  aa 273-723 (ZikaSPH2015-Brazil, Z1106033-Suriname, Natal RGN);
  aa 273-719 (MR766-Uganda)
design 1, design 2:
  design of the UTR elements of the respective mRNA construct;
  for a detailed description see Example 1.1.
GC opt1, GC opt2, GC opt3:
  GC optimization of the coding sequence; for a detailed description see Example 2. RNA In Vitro Transcription The DNA plasmids prepared according to paragraph 1 were enzymatically linearized using EcoRI and transcribed in vitro using DNA dependent T7 RNA polymerase in the presence of a nucleotide mixture (ATP/GTP/CTP/UTP) and cap analog (m7GpppG) under suitable buffer conditions. The obtained mRNAs were purified using PureMessenger® (CureVac, Tübingen, Germany; WO 2008/077592 A1) and used for further experiments (see below).

Alternatively, EcoRI linearized DNA is transcribed in vitro using DNA dependent T7 RNA polymerase in the presence of a modified nucleotide mixture (ATP, GTP, CTP, N(1)-methylpseudouridine (m14)); indicated as "m1ψ" in Table 7) and cap analog (m7GpppG) under suitable buffer conditions. The obtained m1ψ-modified mRNAs are purified using PureMessenger® (CureVac, Tübingen, Germany; WO 2008/077592 A1) and used for further experiments.

Alternatively, some mRNA constructs are in vitro transcribed in the absence of a cap analogon. The cap-structure (Cap1) is added enzymatically using Capping enzymes as commonly known in the art. In short, in vitro transcribed mRNA is capped using an m7G capping kit with 2'-O-methyltransferase to obtain cap1-mRNA. Cap1-mRNA is purified using PureMessenger® (CureVac, Tubingen, Germany; WO 2008/077592 A1) and used for further formulated.

3. Preparation Protamine-Formulated mRNA

Obtained Zika virus mRNA constructs were complexed with protamine prior to use in in vitro and in vivo experiments. The mRNA formulation consisted of a mixture of 50% free mRNA and 50% protamine complexed mRNA. First, mRNA was complexed with protamine in a weight to weight ratio of 2:1 (protamine:RNA) by addition of protamine-Ringer's lactate solution to mRNA. After incubation for 10 minutes, when the complexes were stably generated, free mRNA was added, and the final concentration of the vaccine was adjusted with Ringer's lactate solution.

4. Preparation of LNP Encapsulated mRNA:

Obtained Zika virus mRNA constructs are encapsulated in lipid nanoparticle (LNP)-prior to use in vitro and in vivo experiments. LNP-encapsulated ZIKV mRNA is prepared using an ionizable amino lipid (cationic lipid), phospholipid, cholesterol and a PEGylated lipid. LNPs are prepared as follows. Cationic lipid, DSPC, cholesterol and PEG-lipid are solubilized in ethanol. Briefly, mRNA is diluted to a total concentration of 0.05 mg/mL in 50 mM citrate buffer, pH 4. Syringe pumps are used to mix the ethanolic lipid solution with mRNA at a ratio of about 1:6 to 1:2 (vol/vol). The ethanol is then removed and the external buffer replaced with PBS by dialysis. Finally, the lipid nanoparticles are filtered through a 0.2 μm pore sterile filter. Lipid nanoparticle particle diameter size is determined by quasi-elastic light scattering using a Malvern Zetasizer Nano (Malvern, UK).

5. Preparation of mRNA with additional adjuvant:

Obtained Zika virus mRNA constructs are formulated with a sterilized aluminum phosphate adjuvant (ADJU-PHOS®; Brenntag). mRNA constructs are mixed with the desired amount of aluminum phosphate adjuvant in Ringer's lactate solution.

Example 2: In Vitro Expression Analysis of ZIKV prME and SolE mRNA Constructs

The expression of the ZIKV prME mRNA constructs was determined in vitro in HeLa cells using Western blot.

1. Cell Transfection:

24 h prior to transfection HeLa cells were seeded in a 6-well plate at a density of $4 \times 10^5$ cells/well in cell culture medium (RPMI, 10% FCS, 1% L-Glutamine, 1% Pen/Strep). HeLa cells were transfected with 2 μg protamine-formulated mRNA (see Table 8) using Lipofectamine 2000 (Invitrogen). As a negative control, water for injection (WFI) was used for transfection. As positive controls, irrelevant flaviviral mRNA constructs were used.

TABLE 8

Constructs used for transfection of HeLa cells

| RNA | Antigen information | ZIKV Strain | mRNA Design | Formulation | ID | SEQ ID NO |
|---|---|---|---|---|---|---|
| R29 | $SS_S$-prME | Brazil SPH2015 | Design 1; GC opt1 | free | A | 3297 |
| R1 | X-$SS_C$-prME-XX | Brazil SPH2015 | Design 1; wt | protamine | B | 235 3017 |
| R4 | X-$SS_C$-prME-XX | Brazil SPH2015 | Design 1; GC opt1 | protamine | C | 247 3293 |
| R30 | $SS_S$-prME | Brazil SPH2015 | Design 1; wt | protamine | D | 3021 |
| R29 | $SS_S$-prME | Brazil SPH2015 | Design 1; GC opt1 | protamine | E | 3297 |

TABLE 8-continued

Constructs used for transfection of HeLa cells

| RNA | Antigen information | ZIKV Strain | mRNA Design | Formulation | ID | SEQ ID NO |
|---|---|---|---|---|---|---|
| R7 | $SS_M$-$SolE_{del\_TM}$ | Brazil SPH2015 | Design 1; GC opt1 | protamine | F | 254 3302 |
| R23 | X-$SS_C$-prME-XX | Brazil SPH2015 | Design 2; GC opt1 | protamine | G | 316 |
| R31 | $SS_S$-prME | Brazil SPH2015 | Design 2; GC opt1 | protamine | H | 254 3302 |
| R32 | $SS_S$-prME | Natal RGN | Design 1; GC opt1 | protamine | I | 3300 |
| — | Irrelevant Flavivirus | — | Design 2; GC opt1 | protamine | J | — |
| — | Irrelevant Flavivirus | — | Design 2; GC opt1 | protamine | K | — |

2. Western Blot:

24 hours post transfection, HeLa cells were detached by trypsin-free/EDTA buffer, harvested, and cell lysates were prepared. In addition, virus like particles (VLP) were isolated from cell culture supernatants. Supernatants, harvested 24 hours post transfection, were filtered through a 0.2 μm filter. Clarified supernatants were applied on top of 1 ml 20% sucrose cushion (in PBS) and centrifuged at 14000 rcf (relative centrifugal force) for 2 hours at 4° C. Cell lysates and VLP preparations were subjected to SDS-PAGE under non-denaturating/non-reducing conditions followed by western blot detection. For the detection of ZIKV E-protein expression, a pan-flaviviral E protein-specific antibody (4G2; 1:2000 diluted; Merck Millipore) was used as primary antibody followed by a with secondary anti mouse antibody coupled to IRDye 800CW (Licor Biosciences). The presence of β-actin was analyzed as control for cellular contamination of the supernatants and VLP preparations (anti β-actin; Sigma Aldrich; 1:10000 diluted) in combination with secondary antibody coupled to IRDye 680RD (Licor Biosciences). The results of the experiment are shown in FIG. 1.

Figure 10:
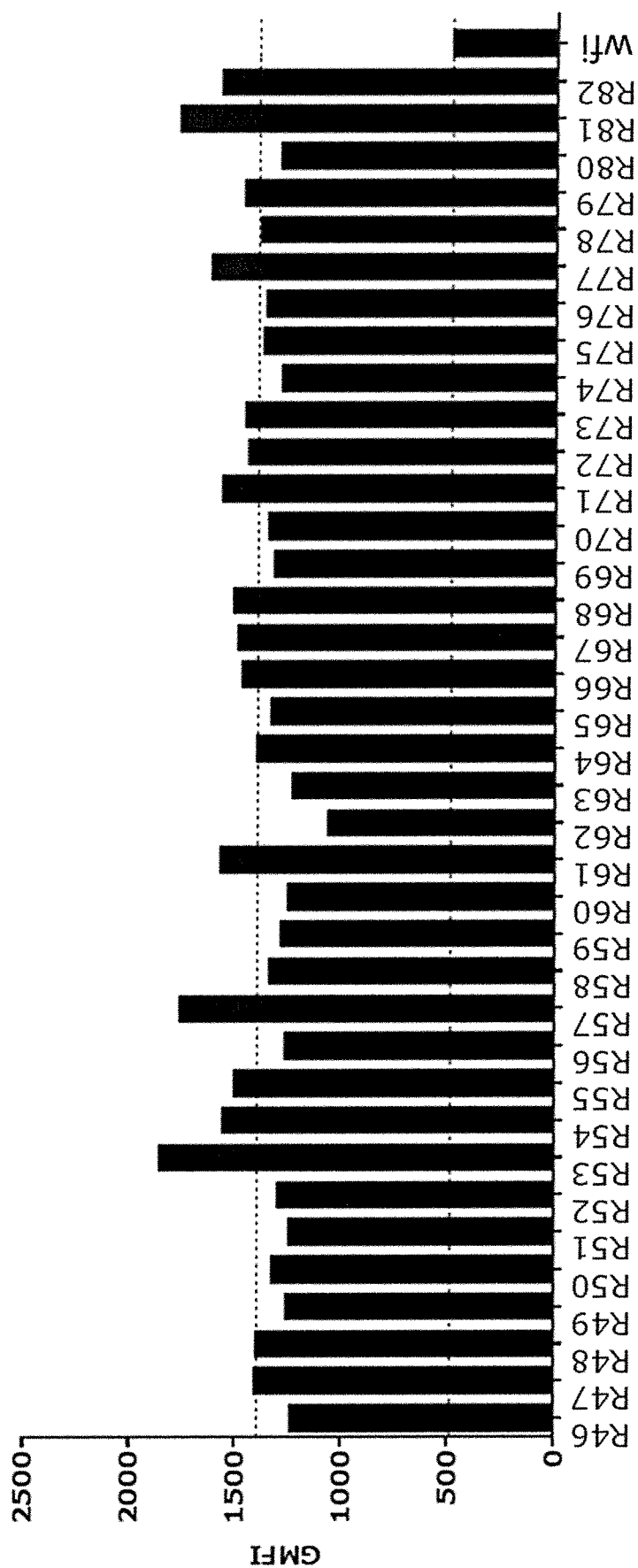
FIG. 10 shows that transfection of HeLa cells with ZIKV prME mRNAs leads to the expression of the respective protein. Analysis was performed by FACS. Constructs used for the experiment are provided (see Table 16). A detailed description of the experiment is provided in the example section, Example 10.

3. Results:

As shown in FIGS. 1A-B, for all tested ZIKV constructs, strong signals could be detected in cell-lysates, showing that all mRNA ZIKV constructs are translated into protein. As shown in FIGS. 10 and 1D, for all tested ZIKV constructs signals could be detected in virus-like particle (VLP) preparations, showing that all mRNA ZIKV constructs are translated and secreted to form VLPs. Signals in the VLP preparations are high for constructs "A", "E", "H" and "I" (for construct design, see Table 8) and rather low for the other constructs. It has to be noted that the western blot analysis is merely useful to assess protein expression and VLP formation. However, protein expression does not always correlate with strong in vivo immunogenicity. For interpretation of the data, it has to be noted that irrespective of the rather weak signal for some of the tested mRNA constructs, all of the analyzed mRNA constructs are expressed in HeLa cells, indicating that all of the tested constructs potentially elicit sufficient immune responses and may therefore be used in a ZIKV vaccine composition according to the present invention.

Example 3: Detection of Binding Antibody Responses in Mice

1. Immunization of Mice:

Female BALB/c mice were injected intradermally (i.d.) with mRNA vaccine compositions (protamine formulated mRNA) with doses, application routes and vaccination schedules as indicated in Table 9. As a negative control, one group of mice was treated with buffer (ringer lactate; RiLa). All animals were vaccinated on day 0, 21 and 35. For the determination of binding antibody titers and analysis of the kinetic of binding antibody responses blood samples were collected on day 21, 35, 49, 63, 77, and 91.

TABLE 9

Vaccination scheme

| Setup | RNA ID | Antigen | ZIKV strain | Design | Formulation | Dose; route; no of mice | SEQ ID NO |
|---|---|---|---|---|---|---|---|
| | | Rila buffer | — | — | — | 2 × 50 μl 8 mice | — |
| 1 | R32 | $SS_S$-prME | Natal RGN | Design 1; GC opt1 | protamine | 80 μg i.d. 2 × 50 μl 8 mice | 3300 |
| 2 | R31 | $SS_S$-prME | Brazil SPH2015 | Design 2; GC opt1 | protamine | 80 μg i.d. 2 × 50 μl 8 mice | 5505 |
| 3 | R29 | $SS_S$-prME | Brazil SPH2015 | Design 1; GC opt1 | protamine | 80 μg i.d. 2 × 50 μl 8 mice | 3297 |

2. Determination of Zika Virus Envelope (E) Protein Specific-Antibodies by ELISA:

Analysis of humoral immune responses was performed in serum samples collected during the study (on day 21, 35, 49, 63, 77, and 91). Binding of Zika virus-specific IgG1 and IgG2a antibodies was analyzed by ELISA using recombinant Zika E protein (Aalto) for coating. Coated plates were incubated using respective serum dilutions, and binding of specific antibodies to the Zika E protein antigens was detected using biotinylated isotype specific anti-mouse antibodies followed by streptavidin-HRP (horse radish peroxidase) with Amplex Ultra Red as substrate. The results of the ELISA analysis are shown in FIG. 2.

Figure 2:
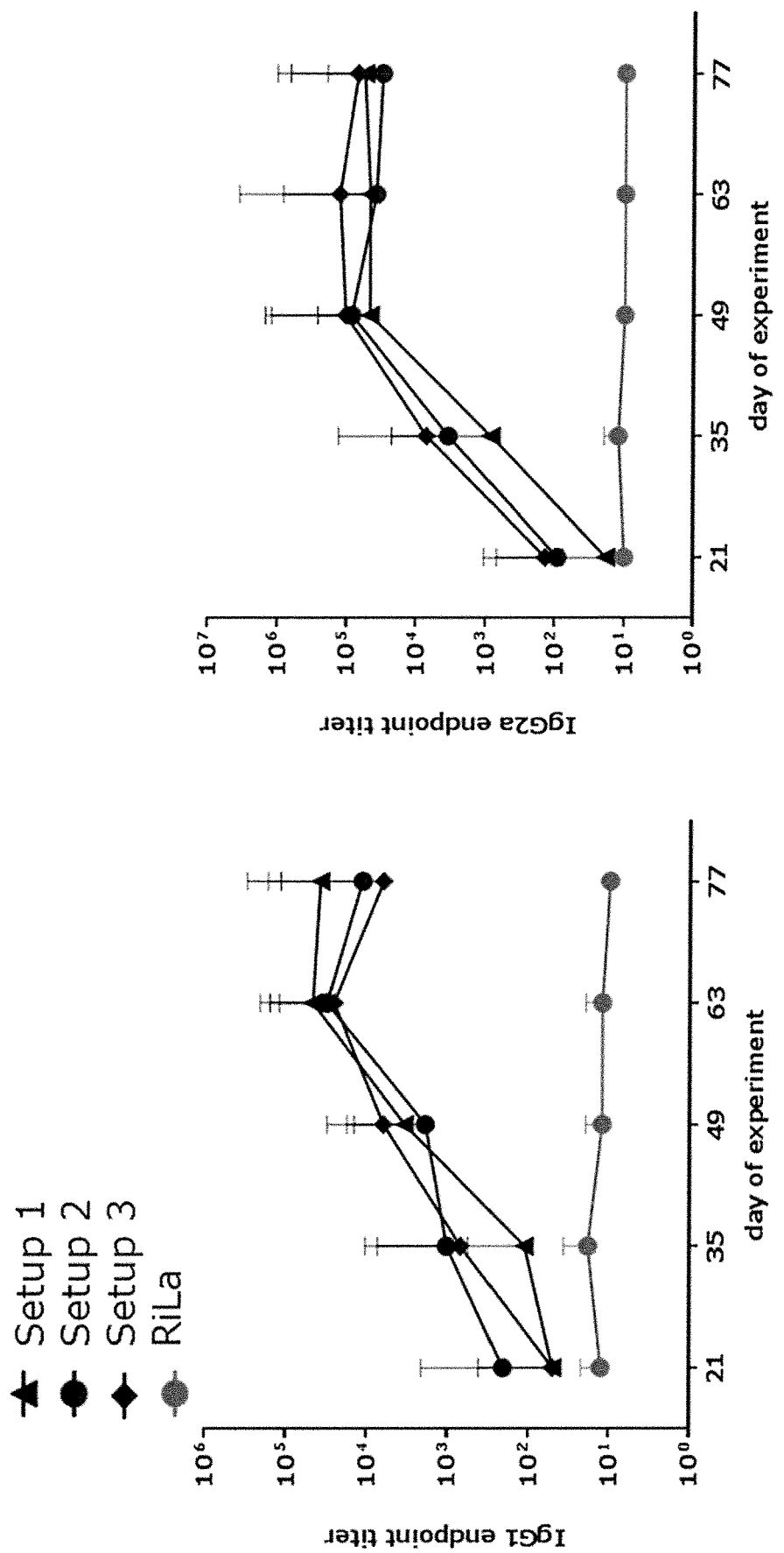
FIG. 2 shows that vaccination of mice with ZIKV mRNA vaccines induced binding IgG1 and IgG2a antibodies (using ELISA). Constructs used for vaccination are formulated Zika virus mRNA vaccines (see Table 9), and Ringer lactate buffer as control. A detailed description of the experiment is provided in the example section, Example 3.

3. Results:

As shown in FIG. 2, binding antibody responses against the injected ZIKV mRNA could be detected for all used vaccine compositions. The results show that the mRNA constructs are translated into protein in vivo, and that the encoded ZIKV proteins induced binding antibodies in vaccinated mice. IgG1 and IgG2 antibody titers remained stable and high after the third vaccination, showing that a long-lived immune response could be triggered by vaccination with the tested ZIKV mRNA vaccines in mice.

Example 4: Detection of Neutralizing Antibody Responses in Mice

1. Immunization of Mice:

Female BALB/c mice were injected intradermally with respective mRNA vaccine compositions (protamine formulated mRNA) with doses, application routes and vaccination schedules as indicated in Table 10. All animals were vaccinated on day 0, 21 and 35. Neutralizing antibody titers were determined using a PRNT50 assay in blood samples collected on day 49.

TABLE 10

Vaccination scheme

| Setup | RNA ID | Antigen | ZIKV strain | Design | Formulation | Dose; route | SEQ ID NO |
|---|---|---|---|---|---|---|---|
| — | — | Rila buffer (RiLa) | — | — | — | 2 × 50 µl | — |
| A | R31 | $SS_S$-prME | Brazil SPH | Design 2; GC opt1 | protamine | 80 µg i.d. 2 × 50 µl 8 mice | 5505 |
| B | R32 | $SS_S$-prME | Natal RGN | Design 1; GC opt1 | protamine | 80 µg i.d. 2 × 50 µl 8 mice | 3300 |

2. Zika Virus Plaque Reduction Neutralization Test (PRNT50):

Serum samples collected on day 49 were analyzed by a plaque reduction neutralization test (PRNT50; performed in the laboratory of Scott Weaver, University Texas Medical Branch, Galveston, USA), performed as commonly known in the art. Briefly, serum samples of vaccinated mice were heat inactivated at 56° C. for 30 min. Serial 2-fold dilutions of the serum was prepared in 2% MEM and mixed with equal volume of Zika virus (strain FSS 13025, isolate from Cambodia, 2010) followed by incubation at 37° C. for 1 h. The serum/virus mixture was added to Vero cells and incubated at 37° C. for 1 h. The cells were overlayed with MEM containing 1% Oxid agar and incubated at 37° C. for 3 days or until plaques appear. The plates were fixed with 10% formaldehyde and stained with 0.25% crystal violet. The PRNT50 titer was calculated as the highest dilution of serum that inhibits 50% of plaques compared to control containing virus without the addition of serum. The result of the experiment is shown in FIG. 3.

Figure 3:
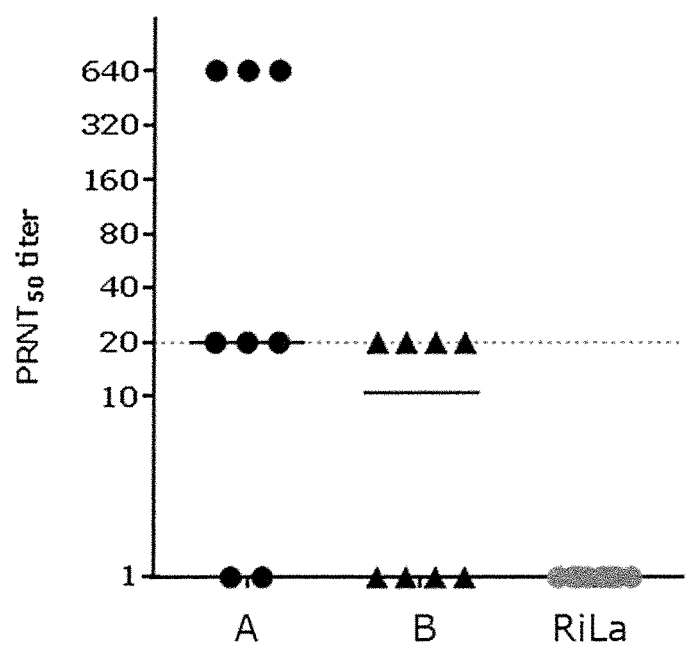
FIG. 3 shows that vaccination of mice with ZIKV mRNA vaccines induced neutralizing antibodies (using PRNT50 assay). Constructs used for vaccination are formulated Zika virus mRNA vaccines (see Table 10), and Ringer lactate buffer as control. A detailed description of the experiment is provided in the example section, Example 4.

3. Results:

As shown in FIG. 3, virus neutralizing antibody responses were detected for both tested ZIKV mRNA vaccine compositions. For setup A (cf. Table 4), 6 out of 8 mice showed neutralizing antibody responses. For setup B (cf. Table 4), 4 out of 8 mice showed neutralizing antibody responses, whereas PRNT titers could not be detected for the buffer control (FIG. 3B). The results show that mRNA based ZIKV vaccine compositions can induce neutralizing antibody responses in vaccinated mice.

Example 5: Detection of T Cell Responses in Mice

1. Immunization of Mice:

Female BALB/c mice were injected intradermally with respective mRNA vaccine compositions (protamine formulated mRNA) with doses, application routes and vaccination schedules as indicated in Table 11. All animals were vaccinated on day 0, 21 and 35. T cell responses were analyzed by intracellular cytokine staining (ICS) using splenocytes isolated on day 91.

TABLE 11

Vaccination scheme

| Setup | RNA ID | Antigen | ZIKV strain | Design | Formulation | Dose; route | SEQ ID NO |
|---|---|---|---|---|---|---|---|
| A | — | Rila buffer | — | — | — | 2 × 50 µl 8 mice | — |
| B | R29 | $SS_S$-prME | Brazil SPH2015 | Design 1; GC opt1 | protamine | 80 µg i.d. 2 × 50 µl 8 mice | 3297 |
| C | R5 | $SS_M$-$SolE_{del\_TM}$ | Brazil SPH2015 | Design 1; GC opt1 | protamine | 80 µg i.d. 2 × 50 µl 8 mice | 249 3301 |
| D | R31 | $SS_S$-prME | Brazil SPH2015 | Design 2; GC opt1 | protamine | 80 µg i.d. 2 × 50 µl 8 mice | 5505 |
| E | R32 | $SS_S$-prME | Natal RGN | Design 1; GC opt1 | protamine | 80 µg i.d. 2 × 50 µl 8 mice | 3300 |

2. Intracellular Cytokine Staining (ICS):

Splenocytes from vaccinated mice were isolated on day 91 according to a standard protocol known in the art. Briefly, isolated spleens were grinded through a cell strainer and washed in PBS/1% FBS followed by red blood cell lysis. After an extensive washing step with PBS/1% FBS splenocytes were seeded into 96-well plates ($2 \times 10^6$ cells per well). The cells were stimulated with overlapping peptides spanning the prM protein (pepmix pool 1) or the envelope protein (pepmix pool 2) (both JPT) of the Zika prME in the presence of 2.5 µg/ml of an anti-CD28 antibody (BD Biosciences) for 6 hours at 37° C. After stimulation, cells were washed, incubated with anti-Thy1.2-FITC, anti-CD4-BD Horizon V450 and anti-CD8-PE-Cy7 followed by permeabilisation using Cytofix/Cytoperm reagent (BD Biosciences) and staining for intracellular cytokines using anti-TNF-PE and anti-IFNγ-APC. Aqua Dye (Invitrogen) was used to distinguish live/dead cells.

Cells were acquired using a Canto 11 flow cytometer (Beckton Dickinson). Flow cytometry data was analyzed using FlowJo software package (Tree Star, Inc.). The results are shown in FIG. 4.

Figure 4:
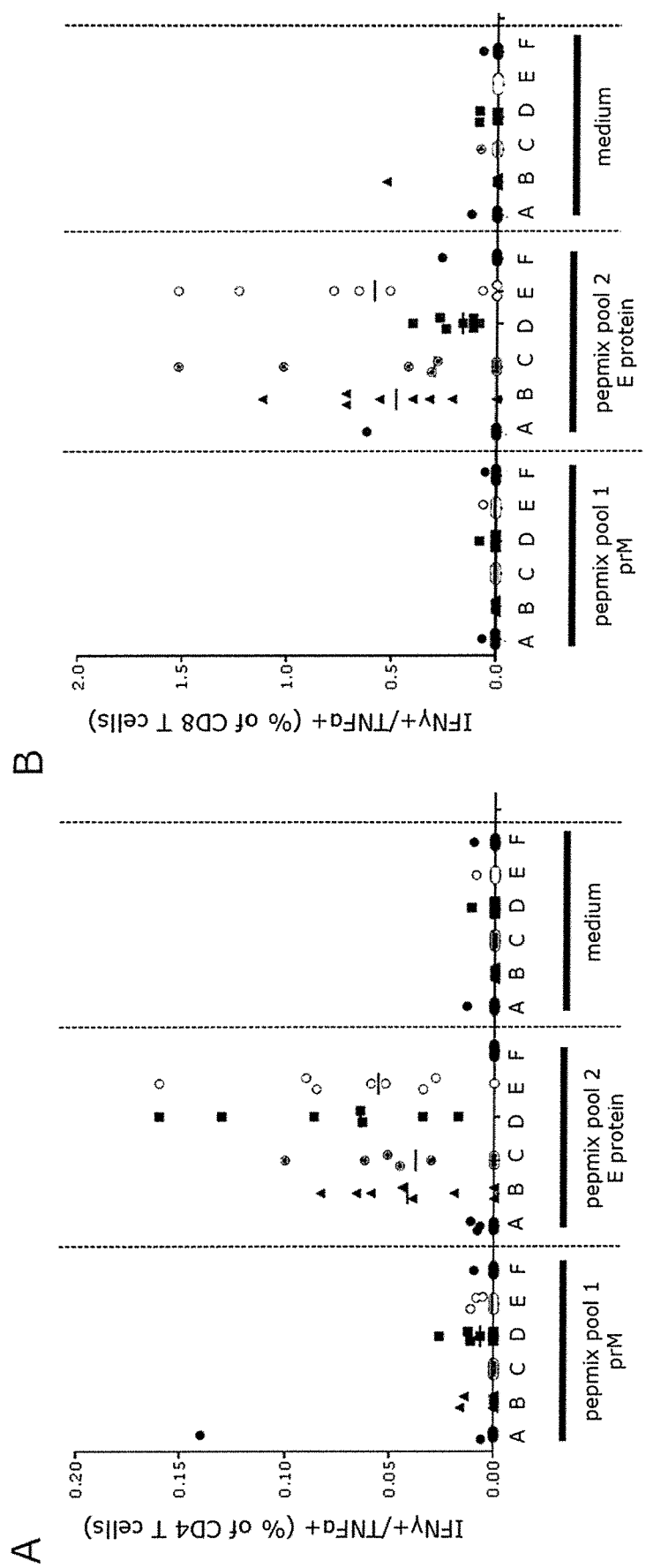
FIG. 4 shows that vaccination of mice with ZIKV mRNA vaccines induced T-cell responses (using ICS). Constructs used for vaccination are formulated Zika virus mRNA vaccines (see Table 11), and Ringer lactate buffer as control. A detailed description of the experiment is provided in the example section, Example 5.

3. Results:

As shown in FIG. 4, induction of TNF- and IFNγ-production was only detected for CD4- and CD8-T-cells stimulated with the peptide mix comprising ZIKV E peptides (pepmix pool 2). T-cells stimulated with peptide mix comprising ZIKV prM peptides (pepmix pool 1) or medium control did not lead to relevant cytokine production, showing that the cytokine production obtained by stimulation with pepmix pool 2 is specific. Therefore, the herein used ZIKV mRNA vaccine compositions induced ZIKV E-protein specific CD4- and CD8T-cell responses in vaccinated mice.

Example 6: ZIKV mRNA Vaccine Study in Non-Human Primates (NHP)

1. Immunization of Cynomolqus Monkeys:

Cynomolgus monkeys (*Macaca fascicularis*) were injected intradermally (i.d.) using Jet injection (needle free Tropis® device, PharmaJet) with ZIKV mRNA vaccine compositions (protamine formulated mRNA) with doses, application routes and vaccination schedules as indicated in Table 12. As a negative control, one group was injected with buffer (ringer lactate; RiLa). All animals were vaccinated on day 1, 29 and 57. Neutralizing antibody titers were determined using a PRNT50 assay in blood samples collected on day 1, 29, 57, and 78.

TABLE 12

Vaccination scheme

| RNA ID | Antigen | ZIKV strain | Design | Formulation; Application | Dose; Route; no of hamster | SEQ ID NO |
|---|---|---|---|---|---|---|
| R29 | SS$_S$-prME | Brazil SPH2015 | Design 1; GC opt1 | Protamine Jet injection | 20 µg i.d. 1 × 100 µl 4 NHPs | 3297 |

2. Zika Virus Plaque Reduction Neutralization Test (PRNT50):

Serum samples of the vaccinated cynomolgus monkeys collected on day 1, 29, 57, and 78 were analyzed by a plaque reduction neutralization test (PRNT50; Southern Research Institute, USA), performed essentially according to Example 4.2. The result of the experiment is shown in FIG. 5.

Figures 5, 6:
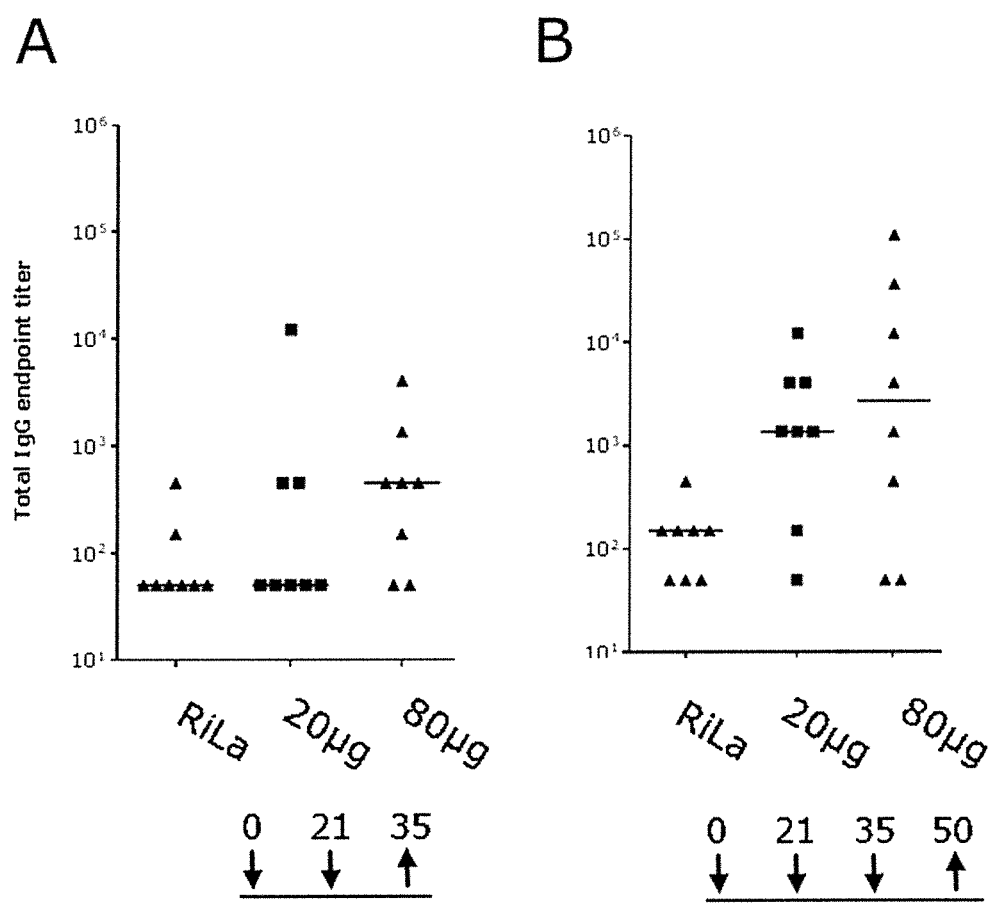
FIG. 5 shows that vaccination of non-human primates (NHPs) with ZIKV mRNA vaccines induced neutralizing antibodies (using PRNT50 assay). Constructs used for vaccination are formulated Zika virus mRNA vaccines (see Table 12). A detailed description of the experiment is provided in the example section, Example 6.
FIG. 6 shows that vaccination of hamsters with ZIKV mRNA vaccines induced binding IgG1 and IgG2a antibodies (using ELISA). Constructs used for vaccination are formulated Zika virus mRNA vaccines (see Table 13), and Ringer lactate buffer as control. Panel A: Results from day 35 serum samples; Panel B: results from day 50 serum samples. A detailed description of the experiment is provided in the example section, Example 7.

3. Results:

As shown in FIG. 5, virus neutralizing antibody responses were detected for the tested ZIKV mRNA vaccine compositions. All vaccinated NHPs showed neutralizing antibody responses on day 57 (after the second vaccination) with increasing responses on day 78 (after the third vaccination). The results show that mRNA based ZIKV vaccine compositions can induce neutralizing antibody responses in vaccinated non-human primates.

Example 7: ZIKV mRNA Vaccine Study in Hamsters

1. Immunization of Hamsters:

Female Syrian golden hamster were injected intradermally (i.d.) with ZIKV mRNA vaccine compositions (protamine formulated mRNA) with doses, application routes and vaccination schedules as indicated in Table 13. As a negative control, one group was injected with buffer (ringer lactate; RiLa). All animals were vaccinated on day 0, 21 and 35. Blood samples were collected on day 35 and 50 for the determination of E-protein specific binding antibody titers and neutralizing antibody titers.

TABLE 13

Hamster vaccination scheme

| Setup | RNA ID | Antigen | ZIKV strain | design | Formulation | Dose/route/ no of hamster | SEQ ID NO |
|---|---|---|---|---|---|---|---|
| A | — | Rila buffer | — | — | — | 2 × 50 µl 8 hamsters | — |
| B | R29 | SS$_S$-prME | Brazil SPH2015 | Design 1; GC opt1 | protamine | 20 µg i.d. 2 × 50 µl 8 hamsters | 3297 |
| C | R29 | SS$_S$-prME | Brazil SPH2015 | Design 1; GC opt1 | protamine | 80 µg i.d. 2 × 50 µl 8 hamsters | 3297 |

2. Determination of Zika Virus Envelope (E) Protein Specific-Antibodies by ELISA:

Analysis of humoral immune responses was performed in serum samples collected on day 50. Binding of Zika virus-specific total IgG antibodies were was analyzed by ELISA using recombinant Zika E protein (Aalto) for coating. Coated plates were incubated using respective serum dilutions, and binding of specific antibodies to the Zika E protein antigens was detected using biotinylated IgG specific anti-Syrian golden hamster antibody followed by streptavidin-HRP (horse radish peroxidase) with Amplex Ultra Red as substrate. The results are shown in FIG. 6.

3. Zika Virus Plaque Reduction Neutralization Test (PRNT):

Serum samples collected on day 50 were analyzed by a plaque reduction neutralization test (PRNT50; performed in the laboratory of Scott Weaver, University Texas Medical Branch, Galveston, USA), was essentially performed according to Example 4.2. The results are shown in FIG. 7.

4. Results:

As shown in FIG. 6, the injected ZIKV prME mRNA vaccine induced binding antibodies against the E protein in vaccinated hamster. After the third vaccination, stable and high IgG antibody titers were observed for both concentrations, showing that a concentration dependent immune response was triggered by vaccination with tested ZIKV mRNA vaccines in hamster.

Figure 7:
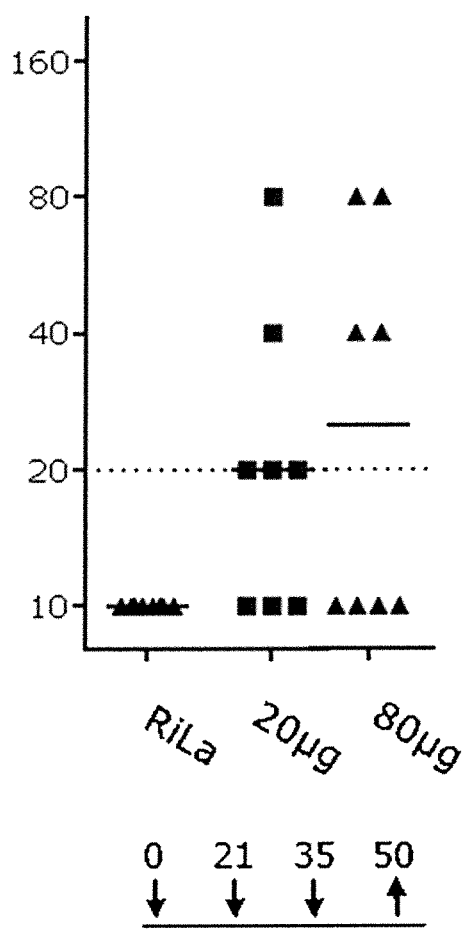
FIG. 7 shows that vaccination of hamsters with ZIKV mRNA vaccines induced neutralizing antibodies (using PRNT50 assay). Constructs used for vaccination are formulated Zika virus mRNA vaccines (see Table 13), and Ringer lactate buffer as control. A detailed description of the experiment is provided in the example section, Example 7.

As shown in FIG. 7, virus neutralizing antibody responses were detected for both tested ZIKV mRNA vaccine doses. 6 out of 8 hamster vaccinated with 20 µg ZIKV prME mRNA and 4 out of 8 hamster vaccinated with 80 µg ZIKV prME mRNA showed neutralizing antibody (cf. Table 4) and 4 out of 8 hamster vaccinated with 80 µg ZIKV prME mRNA (cf. Table 4), whereas PRNT titers could not be detected for the buffer control. The results show that mRNA based ZIKV vaccine compositions can induce neutralizing antibody responses in vaccinated Syrian golden hamster.

Example 8: In Vitro Expression Analysis of ZIKV Fusion Loop Mutants, ZIKV Glycosylation Site Mutants and ZIKV JEV Constructs 1. Cell Transfection:

24 h prior to transfection, HeLa cells were seeded in a 6-well plate at a density of 4×105 cells/well in cell culture medium (RPMI, 10% FCS, 1% L-Glutamine, 1% Pen/Strep). HeLa cells were transfected with 2 µg protamine-formulated mRNA (see Table 14) using Lipofectamine 2000 (Invitrogen). As a negative control, water for injection (WFI) was used for transfection.

TABLE 14

Constructs used for cell transfection

| Setup | RNA ID | Antigen | ZIKV strain | design | Formulation | SEQ ID NO |
|---|---|---|---|---|---|---|
| A | R31 | $SS_S$-prME | Brazil SPH2015 | Design 2; GC opt1 | protamine | 5505 |
| B | R33 | $SS_S$-prME$_{F399S}$ | Brazil SPH2015 | Design 2; GC opt1 | protamine | 5513 |
| C | R34 | $SS_S$-prME$_{N445Q}$ | Brazil SPH2015 | Design 2; GC opt1 | protamine | 5517 |
| D | R35 | $SS_S$-prME$_{del\_stem\_TM}$-JEV | Brazil SPH2015 | Design 2; GC opt1 | protamine | 5520 |

Figure 8:
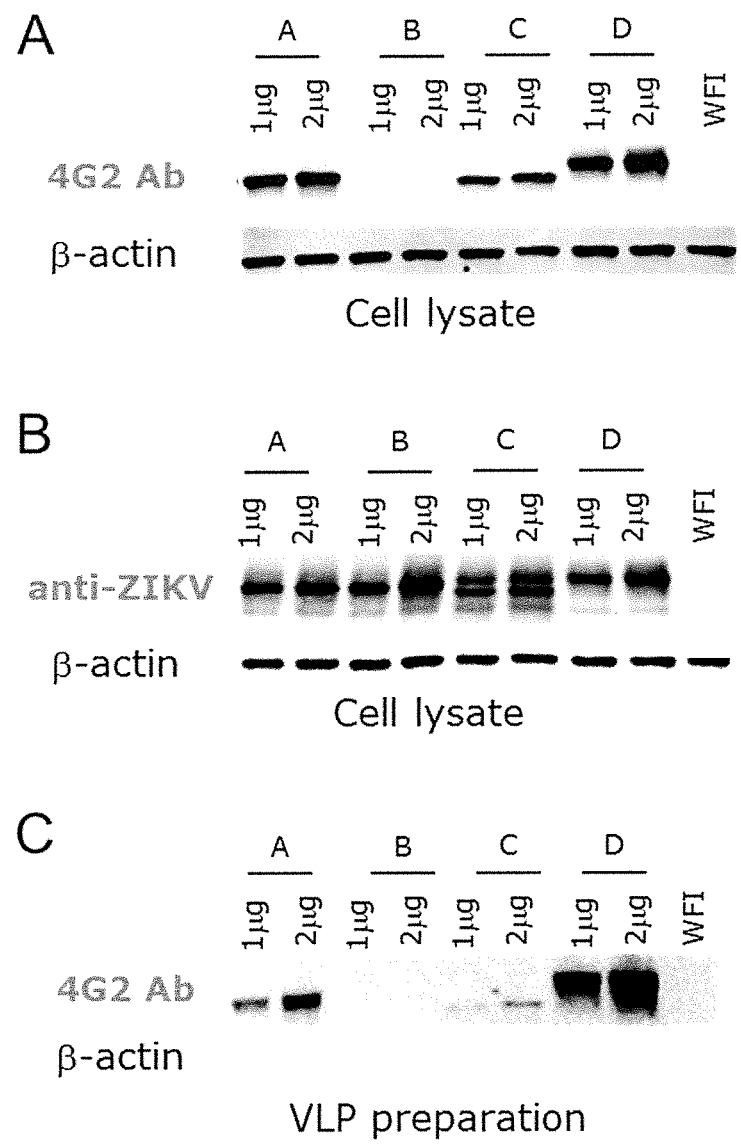
FIG. 8 shows that transfection of HeLa cells with mRNAs coding for Zika virus constructs leads to the expression of the encoded Zika virus proteins. Constructs used for cell transfections are formulated Zika virus mRNA constructs (see Table 14), and a two irrelevant mRNA controls. A detailed description of the experiment is provided in the example section, Example 8.

2. Western Blot:

Western blot experiments were performed essentially according to Example 2. Additionally, ZIKV protein detection, cell lysates were stained with a monoclonal mouse anti-ZIKV IgG1 (Aalto Bio reagents, AZ 1176, Clone: #0302156) as primary antibody in combination with secondary anti-mouse antibody coupled to IRDye 800CW (Licor Biosciences). The results of the experiment are shown in FIG. 8.

3. Results:

As shown in FIG. 8A and FIG. 8B, for all tested ZIKV constructs, strong signals could be detected in cell-lysates, showing that all mRNA ZIKV constructs are translated into protein. As shown in FIG. 8C, for ZIKV constructs "A" and "C" strong signals could also be detected in virus-like particle (VLP) preparations, showing that those ZIKV constructs are translated and secreted in form of VLPs. Signals in the VLP preparations are rather low for the construct "C". For construct "D" (prME fusion loop mutant), no signal was detected using the 4G2 antibody, because that antibody binds to an epitope in the E protein fusion loop which is mutated in construct "B" (see FIG. 8A and FIG. 8C). However, strong signals could be detected with the anti-ZIKV antibody, showing construct "B" is expressed (see FIG. 8C). For interpretation of the data, it has to be noted that irrespective of the rather weak signal for some of the tested mRNA constructs, all of the analyzed mRNA constructs are expressed in HeLa cells, indicating that all of the tested constructs potentially elicit sufficient immune responses and may therefore be used in a ZIKV vaccine composition according to the present invention.

Example 9: Detection of Binding Antibody Responses in Mice

1. Immunization of Mice:

Female BALB/c mice were injected intradermally (i.d.) with mRNA vaccine compositions (protamine formulated mRNA) with doses, application routes and vaccination schedules as indicated in Table 15. As a negative control, one group of mice was vaccinated with buffer (ringer lactate; RiLa). All animals were vaccinated on day 0, 21 and 35. Blood samples were collected on day 21, 35, 49 for the determination of binding antibody titers.

TABLE 15

Vaccination scheme

| | RNA ID | Antigen | ZIKV strain | design | Formulation | Dose/route/ no of mice | SEQ ID NO |
|---|---|---|---|---|---|---|---|
| A | — | RiLa buffer | — | — | — | i.d. 2 × 50 µl | — |
| B | R31 | $SS_S$-prME | Brazil SPH2015 | Design 2; GC opt1 | protamine | 80 µg i.d. 2 × 50 µl 8 mice | 5505 |
| C | R33 | $SS_S$-prME$_{F399S}$ | Brazil SPH2015 | Design 2; GC opt1 | protamine | 80 µg i.d. 2 × 50 µl 8 mice | 5513 |
| D | R34 | $SS_S$-prME$_{N445Q}$ | Brazil SPH2015 | Design 2; GC opt1 | protamine | 80 µg i.d. 2 × 50 µl 8 mice | 5517 |
| E | R35 | $SS_S$-prME$_{del\_stem\_TM}$-JEV | Brazil SPH2015 | Design 2; GC opt1 | protamine | 80 µg i.d. 2 × 50 µl 8 mice | 5520 |

2. Determination of Zika Virus Envelope (E) Protein Specific-Antibodies by ELISA:

Analysis of humoral immune responses was performed in serum samples collected on day 21 and 35. Binding of Zika virus-specific IgG antibodies was analyzed by ELISA essentially according to Example 3.2. The results of the ELISA analysis are shown in FIG. 9.

Figure 9:
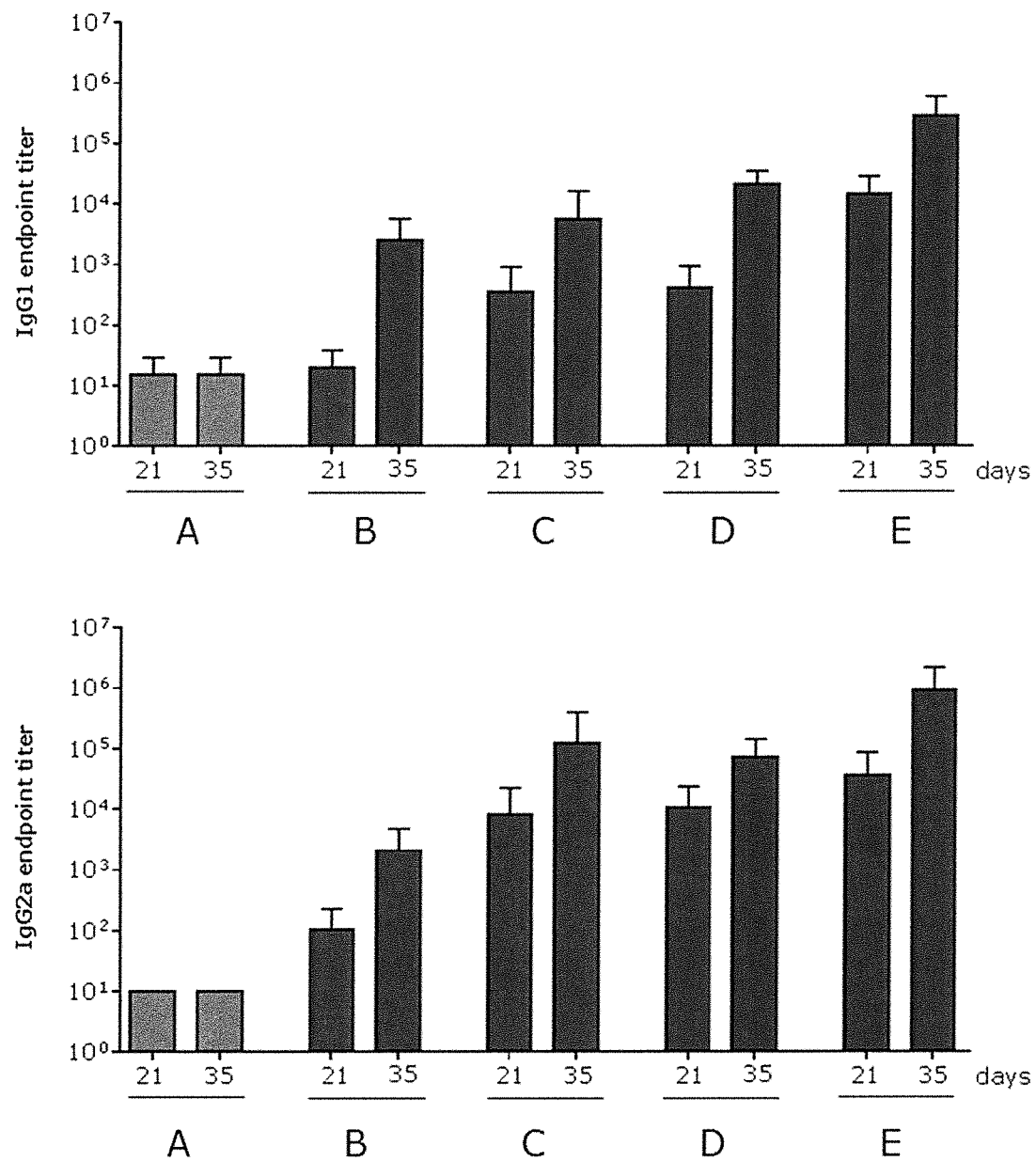
FIG. 9 shows that vaccination of mice with ZIKV mRNA vaccines induced binding IgG1 and IgG2a antibodies (using ELISA). Constructs used for vaccination are formulated Zika virus mRNA vaccines (see Table 15), and Ringer lactate buffer as control. A detailed description of the experiment is provided in the example section, Example 9.

3. Results:

As shown in FIG. 9, all used ZIKV mRNA vaccine compositions induced binding antibodies against the E protein in vaccinated mice. The results show that the mRNA constructs are translated into protein in vivo, and that the encoded ZIKV proteins induced binding antibodies in vaccinated mice. After the boost vaccination, high IgG1 and IgG2 antibody titers are observed, showing that a stable immune response could be triggered by vaccination with the tested ZIKV mRNA vaccines in mice.

Example 10: FACS Expression Analysis of ZIKV Overhang Truncation Constructs

Preparation of DNA and mRNA constructs was performed according to Example 1. In the present example, 37 different variants of prME (Brazil SPH2015, design1, GC opt1) mRNA constructs were tested for their expression using FACS analysis. Those constructs encode protein constructs having varying N-terminal and C-terminal overhangs or a heterologous yellow fever signal peptide (R46-R82 corresponding to SEQ ID NOs: 7754, 7775, 7776, 7777, 7778, 7782, 7784, 7788, 7791, 7792, 7793, 7795, 7797, 7799, 7802, 7809, 7805, 7806, 7807, 7810, 7733, 7734, 7735, 7736, 7756, 7737, 7757, 7759, 7760, 7742, 7763, 7749, 7764, 7747, 7732, 7770, 7771 respectively).

1. FACS Analysis:

HeLa cells were transfected in 6-well plate with 2 µg RNA using Lipofectamine 2000. 20 h post transfection cells were harvested and stained intracellularly using 4G2 antibody (MAB10216) as primary antibody followed by anti-mouse IgG FITC secondary antibody. Detection was carried out using BD FACS Canto II. The result of the analysis is shown in FIG. 10.

2. Results:

As shown in FIG. 10, all constructs are expressed in HeLa cells, indicating that all of the tested constructs may be used in a ZIKV vaccine composition according to the present invention.

Example 11: Vaccination of Mice with AdjuPhos Formulated mRNA Vaccines

1. Immunization:

Female BALB/c mice are injected intradermally (i.d.) and intramuscularly (i.m.) with respective mRNA vaccine compositions (prepared according to Example 1) with doses, application routes and vaccination schedules as indicated in Table 16.

As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

TABLE 16

| | | Vaccination regimen | | |
|---|---|---|---|---|
| Group | No of mice | Vaccine composition | Route/ Volume | Vaccination Schedule (day) |
| 1 | 10 | 80 µg Zika virus RNActive ® Composition 1 | i.d. 2 × 50 µl | 0/21/35 |
| 2 | 10 | 40 µg Zika virus RNActive ® Composition 1 | i.d. 2 × 50 µl | 0/21/35 |
| 3 | 10 | 20 µg Zika virus RNActive ® Composition 1 | i.d. 2 × 50 µl | 0/21/35 |
| 4 | 10 | 40 µg Zika virus RNA + 25 µl Adju-Phos ® Composition 2 | i.m. 2 × 25 µl | 0/21/35 |
| 5 | 10 | 40 µg Zika virus RNA + 12.5 µl Adju-Phos ® Composition 2 | i.m. 2 × 25 µl | 0/21/35 |
| 6 | 10 | 40 µg Zika virus RNA + 6.25 µl Adju-Phos ® Composition 2 | i.m. 2 × 25 µl | 0/21/35 |
| 7 | 10 | 100% RiLa Control | i.d. 2 × 50 µl | 0/21/35 |

2. Determination of Anti Zika Virus Protein Antibodies by ELISA:

ELISA is performed using inactivated Zika virus infected cell lysate for coating. Coated plates are incubated using respective serum dilutions, and binding of specific antibodies to the Zika virus antigens are detected using biotinylated isotype specific anti-mouse antibodies followed by streptavidin-HRP (horse radish peroxidase) with ABTS as substrate.

Endpoint titers of antibodies directed against the Zika virus antigens are measured by ELISA on day 63 after three vaccinations.

3. Intracellular Cytokine Staining

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2 \times 10^6$ cells per well). The cells are stimulated with a mixture of four Zika virus E-protein specific peptide epitopes (5 µg/ml of each peptide) in the presence of 2.5 µg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

4. Zika Virus Plaque Reduction Neutralization Test (PRNT50)

Sera are analyzed by a plaque reduction neutralization test (PRNT50), performed as commonly known in the art. Briefly, obtained serum samples of vaccinated mice are incubated with Zika virus. That mixture is used to infect cultured cells, and the reduction in the number of plaques is determined.

Example 12: ZIKV mRNA Vaccine Challenge Study in NHPs

1. Immunization of Non-Human Primates:
Non-human primates are vaccinated with LNP encapsulated ZIKV mRNA vaccine compositions, protamine complexed ZIKV mRNA compositions (4 NHPs per vaccine composition). As a negative control, one group is injected with buffer (ringer lactate; RiLa). All animals are vaccinated on day 1, 29 and 37. Blood samples are collected on day 1, 29, 57, and 78 for the determination of binding antibody titers and neutralizing antibody titers using a PRNT50 assay. Moreover a ZIKV challenge experiment is performed.
2. Zika Virus Plaque Reduction Neutralization Test (PRNT50):
NHP sera of day 1, 29, 57, and 78 are analyzed by a plaque reduction neutralization test (as commonly known in the art), performed essentially according to Example 4.2.
3. Zika Virus Challenge Experiment:
Non-human primates (5 weeks post immunization) are anesthetized and injected subcutaneously with $10^4$ $TCID_{50}$ of a live ZIKV in 1 ml PBS. Blood samples during the study are collected 1, 3, 5, and 7 days post-challenge. Viral loads are measured in plasma by RT-qPCR for ZIKV RNA.

Example 13: Clinical Development of a Zika Virus mRNA Vaccine Composition

To demonstrate safety and efficiency of the Zika virus mRNA vaccine composition, a clinical trial (phase I) is initiated.

In the clinical trial, a cohort of human volunteers is intradermally or intramuscularly injected for at least two times.

In order to assess the safety profile of the Zika virus vaccine compositions according to the invention, subjects are monitored after administration (vital signs, vaccination site tolerability assessments, hematologic analysis).

The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

---

SEQUENCE LISTING (11759 sequences)

SEQ ID NO: 1 - protein, 3423 aa, Artificial Sequence
  ZIKV (strain ZikaSPH2015) complete polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 2 - protein, 104 aa, Artificial Sequence
  ZIKV (strain ZikaSPH2015) C
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRR

SEQ ID NO: 3 - protein, 122 aa, Artificial Sequence
  ZIKV (strain ZikaSPH2015) C-ER anchor
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMA

SEQ ID NO: 4 - protein, 93 aa, Artificial Sequence
  ZIKV (strain ZikaSPH2015) pr
AEVTRRGSAYYMYLDRNDAGEAISFPTTLGMNKCYIQIMDLGHMCDATMSYECPMLDEGVEPDDVDCWCNTTSTWVVYGTCHHKKGEARRSRR

SEQ ID NO: 5 - protein, 75 aa, Artificial Sequence
  ZIKV (strain ZikaSPH2015) M
AVTLPSHSTRKLQTRSQTWLESREYTKHLIRVENWIFRNPGFALAAAAIAWLLGSSTSQKVIYLVMILLIAPAYS

SEQ ID NO: 6 - protein, 168 aa, Artificial Sequence
  ZIKV (strain ZikaSPH2015) prM
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYS

SEQ ID NO: 7 - protein, 504 aa, Artificial Sequence
  ZIKV (strain ZikaSPH2015) E
IRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 8 - protein, 672 aa, Artificial Sequence
  ZIKV (strain ZikaSPH2015) prME
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9 - protein, 352 aa, Artificial Sequence
  ZIKV (strain ZikaSPH2015) NS1
DVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 10 - protein, 226 aa, Artificial Sequence
  ZIKV (strain ZikaSPH2015) NS2A
GSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKR

SEQ ID NO: 11 - protein, 130 aa, Artificial Sequence
  ZIKV (strain ZikaSPH2015) NS2B
SWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKR

SEQ ID NO: 12 - protein, 617 aa, Artificial Sequence
  ZIKV (strain ZikaSPH2015) NS3
SGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKR

SEQ ID NO: 13 - protein, 150 aa, Artificial Sequence
  ZIKV (strain ZikaSPH2015) NS4A
GAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITA

SEQ ID NO: 14 - protein, 251 aa, Artificial Sequence
  ZIKV (strain ZikaSPH2015) NS4B
NELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRR

SEQ ID NO: 15 - protein, 903 aa, Artificial Sequence
  ZIKV (strain ZikaSPH2015) NS5
GGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 16 - protein, 712 aa, Artificial Sequence
  ZIKV (strain ZikaSPH2015) Polyprotein(93-804)
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 17 - protein, 451 aa, Artificial Sequence
  ZIKV (strain ZikaSPH2015) Polyprotein(273-723)
SQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 18 - protein, 3423 aa, Artificial Sequence
  ZIKV (isolate Z1106033) complete polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 19 - protein, 104 aa, Artificial Sequence; identical to SEQ ID NO: 2
  ZIKV (isolate Z1106033) C

SEQ ID NO: 20 - protein, 122 aa, Artificial Sequence; identical to SEQ ID NO: 3
  ZIKV (isolate Z1106033) C-ER anchor

SEQ ID NO: 21 - protein, 93 aa, Artificial Sequence
  ZIKV (isolate Z1106033) pr
AEVTRRGSAYYMYLDRNDAGEAISFPTTLGMNKCYIQIMDLGHTCDATMSYECPMLDEGVEPDDVDCWCNTTSTWVVYGTCHHKKGEARRSRR

SEQ ID NO: 22 - protein, 75 aa, Artificial Sequence; identical to SEQ ID NO: 5
  ZIKV (isolate Z1106033) M

SEQ ID NO: 23 - protein, 168 aa, Artificial Sequence
  ZIKV (isolate Z1106033) prM
AEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYS

SEQ ID NO: 24 - protein, 504 aa, Artificial Sequence
  ZIKV (isolate Z1106033) E
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 25 - protein, 672 aa, Artificial Sequence
  ZIKV (isolate Z1106033) prME
AEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 26 - protein, 352 aa, Artificial Sequence
  ZIKV (isolate Z1106033) NS1
DVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 27 - protein, 226 aa, Artificial Sequence; identical to SEQ ID NO: 10
  ZIKV (isolate Z1106033) NS2A

SEQ ID NO: 28 - protein, 130 aa, Artificial Sequence; identical to SEQ ID NO: 11
  ZIKV (isolate Z1106033) NS2B

SEQ ID NO: 29 - protein, 617 aa, Artificial Sequence
  ZIKV (isolate Z1106033) NS3
SGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKR

SEQ ID NO: 30 - protein, 150 aa, Artificial Sequence; identical to SEQ ID NO: 13
  ZIKV (isolate Z1106033) NS4A

SEQ ID NO: 31 - protein, 251 aa, Artificial Sequence
  ZIKV (isolate Z1106033) NS4B
NELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRR

SEQ ID NO: 32 - protein, 903 aa, Artificial Sequence; identical to SEQ ID NO: 15
  ZIKV (isolate Z1106033) NS5

SEQ ID NO: 33 - protein, 712 aa, Artificial Sequence
  ZIKV (isolate Z1106033) Polyprotein(93-804)
RIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSK

SEQ ID NO: 34 - protein, 451 aa, Artificial Sequence
  ZIKV (isolate Z1106033) Polyprotein(273-723)
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 35 - protein, 3419 aa, Artificial Sequence
  ZIKV (strain MR 766) complete polyprotein
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFMHGDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKIRWLEERGYLQPYGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLCRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 36 - protein, 104 aa, Artificial Sequence
  ZIKV (strain MR 766) C
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRR

SEQ ID NO: 37 - protein, 122 aa, Artificial Sequence
  ZIKV (strain MR 766) C-ER anchor
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMA

SEQ ID NO: 38 - protein, 93 aa, Artificial Sequence
  ZIKV (strain MR 766) pr
AEITRRGSAYYMYLDRSDAGKAISFATTLGVNKCHVQIMDLGHMCDATMSYECPMLDEGVEPDDVDCWCNTTSTWVVYGTCHHKKGEARRSRR

SEQ ID NO: 39 - protein, 75 aa, Artificial Sequence
  ZIKV (strain MR 766) M
AVTLPSHSTRKLQTRSQTWLESREYTKHLIKVENWIFRNPGFALVAVAIAWLLGSSTSQKVIYLVMILLIAPAYS

SEQ ID NO: 40 - protein, 168 aa, Artificial Sequence
  ZIKV (strain MR 766) prM
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYS

SEQ ID NO: 41 - protein, 500 aa, Artificial Sequence
  ZIKV (strain MR 766) E
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 42 - protein, 668 aa, Artificial Sequence
  ZIKV (strain MR 766) prME
AEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 43 - protein, 352 aa, Artificial Sequence
  ZIKV (strain MR 766) NS1
DVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTA

SEQ ID NO: 44 - protein, 226 aa, Artificial Sequence
  ZIKV (strain MR 766) NS2A
GSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKR

SEQ ID NO: 45 - protein, 130 aa, Artificial Sequence
  ZIKV (strain MR 766) NS2B
SWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKR

SEQ ID NO: 46 - protein, 617 aa, Artificial Sequence
  ZIKV (strain MR 766) NS3
SGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKR

SEQ ID NO: 47 - protein, 150 aa, Artificial Sequence
  ZIKV (strain MR 766) NS4A
GAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITA

SEQ ID NO: 48 - protein, 251 aa, Artificial Sequence
  ZIKV (strain MR 766) NS4B
NELGWLERTKNDIAHLMGRREEGATMGFSMDIDLRPASAWAIYAALTTLITPAVQHAVTTSYNNYSLMAMATQAGVLFGMGKGMPFMHGDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRR

SEQ ID NO: 49 - protein, 903 aa, Artificial Sequence
  ZIKV (strain MR 766) NS5
GGGTGETLGEKWKARLNQMSALEFYSYKKSGITEVCREEARRALKDGVATGGHAVSRGSAKIRWLEERGYLQPYGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLCRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 50 - protein, 708 aa, Artificial Sequence
  ZIKV (strain MR 766) Polyprotein(93-800)
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 51 - protein, 447 aa, Artificial Sequence
  ZIKV (strain MR 766) Polyprotein(273-719)
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 52 - RNA, 10269 nt, Artificial Sequence
  ZIKV (strain ZikaSPH2015) complete polyprotein CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaucacuucucccuuggagugcuugugauucugcucauggugcaggaagggcugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacgugguggggcugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccaauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaagcccuuagagggcuuccagugcguuauaugacaacagcagucaaugucacccacucuggaacagaaaucgucgacuuaaugugccaugccaccuucacuucacgucuacuacagccaaucagaguccccaacuauaaucuguauauuauggaugaggcccacuucacagaucccucaaguauagcagcaagaggauacauuucaacaaggguugagaugggcgaggcggcugccaucuucaugaccgccacgccaccaggaacccgugacgcauuuccggacuccaacucaccaauuauggacaccgaaguggaagucccagagagagccuggagcucaggcuuugauugggugacggauuauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagagguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuuuuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccaugggauucucaauggacauugaccugcggccagccucagcuugggccaucuaugcugccuugacaacuuucauuaccccagccguccaacaugcagugaccacuucauacaacaacuacuccuuaauggcgauggccacgcaagcuggaguguuguuugguaugggcaaagggaugccauucuacgcaugggacuuuggagucccgcugcuaaugauagguugcuacucacaauuaacgccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauggcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaagguacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucgcauaccaggaggaaggauguaugcagaugacacugcuggcugggacacccgcaucagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguccuagagaugcaagacuuguggcugcugcggaggucagagaaagugaccaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcug

SEQ ID NO: 53 - RNA, 312 nt, Artificial Sequence
  ZIKV (strain ZikaSPH2015) C CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgg

SEQ ID NO: 54 - RNA, 366 nt, Artificial Sequence
  ZIKV (strain ZikaSPH2015) C-ER anchor CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggca

SEQ ID NO: 55 - RNA, 279 nt, Artificial Sequence
  ZIKV (strain ZikaSPH2015) pr CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaaga

SEQ ID NO: 56 - RNA, 225 nt, Artificial Sequence
  ZIKV (strain ZikaSPH2015) M CDS mRNA wild type
gcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagc

SEQ ID NO: 57 - RNA, 504 nt, Artificial Sequence
  ZIKV (strain ZikaSPH2015) prM CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagc

SEQ ID NO: 58 - RNA, 1512 nt, Artificial Sequence
  ZIKV (strain ZikaSPH2015) E CDS mRNA wild type
aucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 59 - RNA, 2016 nt, Artificial Sequence
  ZIKV (strain ZikaSPH2015) prME CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 60 - RNA, 1056 nt, Artificial Sequence
  ZIKV (strain ZikaSPH2015) NS1 CDS mRNA wild type
gauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 61 - RNA, 678 nt, Artificial Sequence
  ZIKV (strain ZikaSPH2015) NS2A CDS mRNA wild type
ggaucaacugaucacauggaucacuucucccuuggagugcuugugauucugcucauggugcaggaagggcugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacgugguggggcugcuguugcucacaaggagugggaagcgg

SEQ ID NO: 62 - RNA, 390 nt, Artificial Sequence
  ZIKV (strain ZikaSPH2015) NS2B CDS mRNA wild type
agcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaagg

SEQ ID NO: 63 - RNA, 1851 nt, Artificial Sequence
  ZIKV (strain ZikaSPH2015) NS3 CDS mRNA wild type
aguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccaauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaagcccuuagagggcuuccagugcguuauaugacaacagcagucaaugucacccacucuggaacagaaaucgucgacuuaaugugccaugccaccuucacuucacgucuacuacagccaaucagaguccccaacuauaaucuguauauuauggaugaggcccacuucacagaucccucaaguauagcagcaagaggauacauuucaacaaggguugagaugggcgaggcggcugccaucuucaugaccgccacgccaccaggaacccgugacgcauuuccggacuccaacucaccaauuauggacaccgaaguggaagucccagagagagccuggagcucaggcuuugauugggugacggauuauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagagguguggaccagacacggagagaaaagagugcucaaaccgagguggauggacgccagaguuuguucagaucaugcggcccugaagucauucaaggaguuugccgcugggaaaaga

SEQ ID NO: 64 - RNA, 450 nt, Artificial Sequence
  ZIKV (strain ZikaSPH2015) NS4A CDS mRNA wild type
ggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuuuuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgcc

SEQ ID NO: 65 - RNA, 753 nt, Artificial Sequence
  ZIKV (strain ZikaSPH2015) NS4B CDS mRNA wild type
aaugaacucggaugguuggagagaacaaagagugaccuaagccaucuaaugggaaggagagaggagggggcaaccaugggauucucaauggacauugaccugcggccagccucagcuugggccaucuaugcugccuugacaacuuucauuaccccagccguccaacaugcagugaccacuucauacaacaacuacuccuuaauggcgauggccacgcaagcuggaguguuguuugguaugggcaaagggaugccauucuacgcaugggacuuuggagucccgcugcuaaugauagguugcuacucacaauuaacgccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauggcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacgu

SEQ ID NO: 66 - RNA, 2709 nt, Artificial Sequence
  ZIKV (strain ZikaSPH2015) NS5 CDS mRNA wild type
ggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaagguacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucgcauaccaggaggaaggauguaugcagaugacacugcuggcugggacacccgcaucagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguccuagagaugcaagacuuguggcugcugcggaggucagagaaagugaccaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcug

SEQ ID NO: 67 - RNA, 2136 nt, Artificial Sequence
  ZIKV (strain ZikaSPH2015) Polyprotein(93-804) CDS mRNA wild type
agaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 68 - RNA, 2136 nt, Artificial Sequence
  ZIKV (strain ZikaSPH2015) Polyprotein(93-804) CDS mRNA wild type
agaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 69 - RNA, 1353 nt, Artificial Sequence
  ZIKV (strain ZikaSPH2015) Polyprotein(273-723) CDS mRNA wild type
agccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 70 - RNA, 10269 nt, Artificial Sequence
  ZIKV (isolate Z1106033) complete polyprotein CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaccacuucucccuuggagugcuugugauucugcucauggugcaggaaggguugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacguggugggacugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccuauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaggcccuuagagggcuuccagugcguuauaugacaacagcagucaaugucacccacucuggaacagaaaucgucgacuuaaugugccaugccaccuucacuucgcgucuacuacagccaaucagaguccccaacuauaaucuguauauuauggaugaggcccacuucacagaucccucaaguauagcagcaagaggauacauuucaacaaggguugagaugggcgaggcggccgccaucuucaugaccgccacgccaccaggaacccgugacgcauuuccggacuccaacucaccaauuauggacaccgaaguggaagucccagagagagccuggagcucaggcuuugauugggugacggaucauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagaaguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuucuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccauaggauucucaauggacauugaccugcggccagccucagcuugggccaucuaugcugccuugacaacuuucauuaccccagccguccaacaugcagugaccaccucauacaacaacuacuccuuaauggcgauggccacgcaagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaaggcacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucguauaccaggaggaaggauguaugcagaugacacugcuggcugggacacccgcauuagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguucuagagaugcaagacuuguggcugcugcggaggucagagaaagugacuaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcug

SEQ ID NO: 71 - RNA, 312 nt, Artificial Sequence
  ZIKV (isolate Z1106033) C CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacga

SEQ ID NO: 72 - RNA, 366 nt, Artificial Sequence
  ZIKV (isolate Z1106033) C-ER anchor CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggca

SEQ ID NO: 73 - RNA, 279 nt, Artificial Sequence
  ZIKV (isolate Z1106033) pr CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaaga

SEQ ID NO: 74 - RNA, 225 nt, Artificial Sequence; identical to SEQ ID NO: 56
  ZIKV (isolate Z1106033) M CDS mRNA wild type

SEQ ID NO: 75 - RNA, 504 nt, Artificial Sequence
  ZIKV (isolate Z1106033) prM CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagc

SEQ ID NO: 76 - RNA, 1512 nt, Artificial Sequence
  ZIKV (isolate Z1106033) E CDS mRNA wild type
aucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 77 - RNA, 2016 nt, Artificial Sequence
  ZIKV (isolate Z1106033) prME CDS mRNA wild type
gcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 78 - RNA, 1056 nt, Artificial Sequence
  ZIKV (isolate Z1106033) NS1 CDS mRNA wild type
gauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 79 - RNA, 678 nt, Artificial Sequence
  ZIKV (isolate Z1106033) NS2A CDS mRNA wild type
ggaucaacugaucacauggaccacuucucccuuggagugcuugugauucugcucauggugcaggaaggguugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacguggugggacugcuguugcucacaaggagugggaagcgg

SEQ ID NO: 80 - RNA, 390 nt, Artificial Sequence; identical to SEQ ID NO: 62
  ZIKV (isolate Z1106033) NS2B CDS mRNA wild type

SEQ ID NO: 81 - RNA, 1851 nt, Artificial Sequence
  ZIKV (isolate Z1106033) NS3 CDS mRNA wild type
aguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccuauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaggcccuuagagggcuuccagugcguuauaugacaacagcagucaaugucacccacucuggaacagaaaucgucgacuuaaugugccaugccaccuucacuucgcgucuacuacagccaaucagaguccccaacuauaaucuguauauuauggaugaggcccacuucacagaucccucaaguauagcagcaagaggauacauuucaacaaggguugagaugggcgaggcggccgccaucuucaugaccgccacgccaccaggaacccgugacgcauuuccggacuccaacucaccaauuauggacaccgaaguggaagucccagagagagccuggagcucaggcuuugauugggugacggaucauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagaaguguggaccagacacggagagaaaagagugcucaaaccgagguggauggacgccagaguuuguucagaucaugcggcccugaagucauucaaggaguuugccgcugggaaaaga

SEQ ID NO: 82 - RNA, 450 nt, Artificial Sequence
  ZIKV (isolate Z1106033) NS4A CDS mRNA wild type
ggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuucuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgcc

SEQ ID NO: 83 - RNA, 753 nt, Artificial Sequence
  ZIKV (isolate Z1106033) NS4B CDS mRNA wild type
aaugaacucggaugguuggagagaacaaagagugaccuaagccaucuaaugggaaggagagaggagggggcaaccauaggauucucaauggacauugaccugcggccagccucagcuugggccaucuaugcugccuugacaacuuucauuaccccagccguccaacaugcagugaccaccucauacaacaacuacuccuuaauggcgauggccacgcaagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacgu

SEQ ID NO: 84 - RNA, 2709 nt, Artificial Sequence
  ZIKV (isolate Z1106033) NS5 CDS mRNA wild type
ggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaaggcacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucguauaccaggaggaaggauguaugcagaugacacugcuggcugggacacccgcauuagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguucuagagaugcaagacuuguggcugcugcggaggucagagaaagugacuaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcug

SEQ ID NO: 85 - RNA, 2136 nt, Artificial Sequence
  ZIKV (isolate Z1106033) Polyprotein(93-804) CDS mRNA wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaag

SEQ ID NO: 86 - RNA, 2136 nt, Artificial Sequence
  ZIKV (isolate Z1106033) Polyprotein(93-804) CDS mRNA wild type
agaauaaucaaugcuaggaaggagaagaagagacgaggcgcagauacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaag

SEQ ID NO: 87 - RNA, 1353 nt, Artificial Sequence
  ZIKV (isolate Z1106033) Polyprotein(273-723) CDS mRNA wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 88 - RNA, 10257 nt, Artificial Sequence
  ZIKV (strain MR 766) complete polyprotein CDS mRNA wild type
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcggggucaaccgaucauauggaccacuucucucuuggagugcuugugauucuacucauggugcaggagggguugaagaagagaaugaccacaaagaucaucaugagcacaucaauggcagugcugguagucaugaucuugggaggauuuucaaugagugaccuggccaagcuugugauccugaugggugcuacuuucgcagaaaugaacacuggaggagauguagcucacuuggcauugguagcggcauuuaaagucagaccagccuugcuggucuccuucauuuucagagccaauuggacaccccgugagagcaugcugcuagcccuggcuucgugucuucugcaaacugcgaucucugcucuugaaggugacuugaugguccucauuaauggauuugcuuuggccugguuggcaauucgagcaauggccgugccacgcacugacaacaucgcucuaccaaucuuggcugcucuaacaccacuagcucgaggcacacugcucguggcauggagagcgggccuggcuacuuguggagggaucaugcuccucucccugaaagggaaagguagugugaagaagaaccugccauuugucauggcccugggauugacagcugugaggguaguagacccuauuaaugugguaggacuacuguuacucacaaggagugggaagcggagcuggcccccuagugaaguucucacagccguuggccugauaugugcacuggccggaggguuugccaaggcagacauugagauggcuggacccauggcugcaguaggcuugcuaauugucagcuauguggucucgggaaagaguguggacauguacauugaaagagcaggugacaucacaugggaaaaggacgcggaagucacuggaaacaguccucggcuugacguggcacuggaugagaguggugacuucuccuugguagaggaagaugguccacccaugagagagaucauacucaaggugguccugauggccaucuguggcaugaacccaauagcuauaccuuuugcugcaggagcgugguauguguaugugaagacugggaaaaggaguggcgcccucugggacgugccugcucccaaagaagugaagaaaggagagaccacagauggaguguacagagugaugacucgcagacugcuagguucaacacagguuggagugggagucaugcaagagggagucuuccacaccauguggcacguuacaaaaggagccgcacugaggagcggugagggaagacuugauccauacuggggggaugucaagcaggacuuggugucauacugugggccuuggaaguuggaugcagcuugggauggacucagcgagguacagcuuuuggccguaccucccggagagagggccagaaacauucagacccugccuggaauauucaagacaaaggacggggacaucggagcaguugcucuggacuacccugcagggaccucaggaucuccgauccuagacaaauguggaagagugauaggacucuauggcaaugggguugugaucaagaauggaagcuauguuagugcuauaacccagggaaagagggaggaggagacuccgguugaauguuucgaacccucgaugcugaagaagaagcagcuaacugucuuggaucugcauccaggagccggaaaaaccaggagaguucuuccugaaauaguccgugaagccauaaaaaagagacuccggacagugaucuuggcaccaacuaggguugucgcugcugagauggaggaggccuugagaggacuuccggugcguuacaugacaacagcagucaacgucacccauucugggacagaaaucguugauuugaugugccaugccacuuucacuucacgcuuacuacaacccaucagagucccuaauuacaaucucaacaucauggaugaagcccacuucacagaccccucaaguauagcugcaagaggauacauaucaacaaggguugaaaugggcgaggcggcugccauuuuuaugacugccacaccaccaggaacccgugaugcguuuccugacucuaacucaccaaucauggacacagaaguggaagucccagagagagccuggagcucaggcuuugauugggugacagaccauucugggaaaacaguuugguucguuccaagcgugagaaacggaaaugaaaucgcagccugucugacaaaggcuggaaagcgggucauacagcucagcaggaagacuuuugagacagaauuucagaaaacaaaaaaucaagagugggacuuugucauaacaacugacaucucagagaugggcgccaacuucaaggcugaccgggucauagacucuaggagaugccuaaaaccagucauacuugauggugagagagucaucuuggcugggcccaugccugucacgcaugcuagugcugcucagaggagaggacguauaggcaggaacccuaacaaaccuggagaugaguacauguauggaggugggugugcagagacugaugaaggccaugcacacuggcuugaagcaagaaugcuucuugacaacaucuaccuccaggauggccucauagccucgcucuaucggccugaggccgauaagguagccgccauugagggagaguuuaagcugaggacagagcaaaggaagaccuucguggaacucaugaagagaggagaccuucccgucuggcuagccuaucagguugcaucugccggaauaacuuacacagacagaagauggugcuuugauggcacaaccaacaacaccauaauggaagacaguguaccagcagagguuuggacaaaguauggagagaagagagugcucaaaccgagauggauggaugcuagggucuguucagaccaugcggcccugaagucguucaaagaauucgccgcuggaaaaagaggagcggcuuugggaguaauggaggcccugggaacacugccaggacacaugacagagagguuucaggaagccauugacaaccucgccgugcucaugcgagcagagacuggaagcaggccuuauaaggcagcggcagcccaacugccggagacccuagagaccauuaugcucuuagguuugcugggaacaguuucacuggggaucuucuucgucuugaugcggaauaagggcaucgggaagaugggcuuuggaaugguaacccuuggggccagugcauggcucauguggcuuucggaaauugaaccagccagaauugcauguguccucauuguuguguuuuuauuacugguggugcucauacccgagccagagaagcaaagaucuccccaagauaaccagauggcaauuaucaucaugguggcagugggccuucuagguuugauaacugcaaacgaacuuggauggcuggaaagaacaaaaaaugacauagcucaucuaaugggaaggagagaagaaggagcaaccaugggauucucaauggacauugaucugcggccagccuccgccugggcuaucuaugccgcauugacaacucucaucaccccagcuguccaacaugcgguaaccacuucauacaacaacuacuccuuaauggcgauggccacacaagcuggagugcuguuuggcaugggcaaagggaugccauuuaugcauggggaccuuggagucccgcugcuaaugauggguugcuauucacaauuaacaccccugacucugauaguagcuaucauucugcuuguggcgcacuacauguacuugaucccaggccuacaagcggcagcagcgcgugcugcccagaaaaggacagcagcuggcaucaugaagaaucccguuguggauggaauagugguaacugacauugacacaaugacaauagacccccagguggagaagaagaugggacaaguguuacucauagcaguagccaucuccagugcugugcugcugcggaccgccuggggauggggggaggcuggagcucugaucacagcagcgaccuccaccuugugggaaggcucuccaaacaaauacuggaacuccucuacagccaccucacugugcaacaucuucagaggaagcuaucuggcaggagcuucccuuaucuauacagugacgagaaacgcuggccugguuaagagacguggaggugggacgggagagacucugggagagaaguggaaagcucgucugaaucagaugucggcccuggaguucuacucuuauaaaaagucagguaucacugaaguguguagagaggaggcucgccgugcccucaaggauggaguggccacaggaggacaugccguaucccggggaagugcaaagaucagaugguuggaggagagaggauaucugcagcccuaugggaagguuguugaccucggauguggcagagggggcuggagcuauuaugccgccaccauccgcaaagugcaggaggugagaggauacacaaagggaggucccggucaugaagaacccaugcuggugcaaagcuauggguggaacauaguucgucucaagaguggaguggacgucuuccacauggcggcugagccgugugacacucugcugugugacauaggugagucaucaucuaguccugaaguggaagagacacgaacacucagagugcucucuauggugggggacuggcuugaaaaaagaccaggggccuucuguauaaaggugcugugcccauacaccagcacuaugauggaaaccauggagcgacugcaacguaggcaugggggaggauuagucagagugccauugugucgcaacuccacacaugagauguacugggucucuggggcaaagagcaacaucauaaaaaguguguccaccacaagucagcuccuccugggacgcauggauggccccaggaggccagugaaauaugaggaggaugugaaccucggcucggguacacgagcuguggcaagcugugcugaggcuccuaacaugaaaaucaucggcaggcgcauugagagaauccgcaaugaacaugcagaaacaugguuucuugaugaaaaccacccauacaggacaugggccuaccaugggagcuacgaagcccccacgcaaggaucagcgucuucccucgugaacgggguuguuagacuccugucaaagccuugggacguggugacuggaguuacaggaauagccaugacugacaccacaccauacggccaacaaagagucuucaaagaaaaaguggacaccagggugccagauccccaagaaggcacucgccagguaaugaacauagucucuuccuggcuguggaaggagcuggggaaacgcaagcggccacgcgucugcaccaaagaagaguuuaucaacaaggugcgcagcaaugcagcacugggagcaauauuugaagaggaaaaagaauggaagacggcuguggaagcugugaaugauccaagguuuugggcccuaguggauagggagagagaacaccaccugagaggagagugucacagcuguguguacaacaugaugggaaaaagagaaaagaagcaaggagaguucgggaaagcaaaagguagccgcgccaucugguacaugugguugggagccagauucuuggaguuugaagcccuuggauucuugaacgaggaccauuggaugggaagagaaaacucaggagguggagucgaaggguuaggauugcaaagacuuggauacauucuagaagaaaugaaucgggcaccaggaggaaagauguacgcagaugacacugcuggcugggacacccgcauuaguaaguuugaucuggagaaugaagcucugauuaccaaccaaauggaggaagggcacagaacucuggcguuggccgugauuaaauacacauaccaaaacaaaguggugaagguucucagaccagcugaaggaggaaaaacaguuauggacaucauuucaagacaagaccagagagggaguggacaaguugucacuuaugcucucaacacauucaccaacuugguggugcagcuuauccggaacauggaagcugaggaaguguuagagaugcaagacuuaugguuguugaggaagccagagaaagugaccagaugguugcagagcaauggaugggauagacucaaacgaauggcggucaguggagaugacugcguugugaagccaaucgaugauagguuugcacaugcccucagguucuugaaugacaugggaaaaguuaggaaagacacacaggaguggaaacccucgacuggauggagcaauugggaagaagucccguucugcucccaccacuucaacaagcuguaccucaaggaugggagauccauuguggucccuugccgccaccaagaugaacugauuggccgagcucgcgucucaccaggggcaggauggagcauccgggagacugccugucuugcaaaaucauaugcgcagauguggcagcuccuuuauuuccacagaagagaccuucgacugauggcuaaugccauuugcucggcugugccaguugacuggguaccaacugggagaaccaccuggucaauccauggaaagggagaauggaugaccacugaggacaugcucaugguguggaauagaguguggauugaggagaacgaccauauggaggacaagacuccuguaacaaaauggacagacauucccuaucuaggaaaaagggaggacuuaugguguggaucccuuauagggcacagaccccgcaccacuugggcugaaaacaucaaagacacagucaacauggugcgcaggaucauaggugaugaagaaaaguacauggacuaucuauccacccaaguccgcuacuugggugaggaaggguccacacccggaguguug

SEQ ID NO: 89 - RNA, 312 nt, Artificial Sequence
  ZIKV (strain MR 766) C CDS mRNA wild type
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacgu

SEQ ID NO: 90 - RNA, 366 nt, Artificial Sequence
  ZIKV (strain MR 766) C-ER anchor CDS mRNA wild type
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggca

SEQ ID NO: 91 - RNA, 279 nt, Artificial Sequence
  ZIKV (strain MR 766) pr CDS mRNA wild type
gcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaaga

SEQ ID NO: 92 - RNA, 225 nt, Artificial Sequence
  ZIKV (strain MR 766) M CDS mRNA wild type
gccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacagu

SEQ ID NO: 93 - RNA, 504 nt, Artificial Sequence
  ZIKV (strain MR 766) prM CDS mRNA wild type
gcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacagu

SEQ ID NO: 94 - RNA, 1500 nt, Artificial Sequence
  ZIKV (strain MR 766) E CDS mRNA wild type
aucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 95 - RNA, 2004 nt, Artificial Sequence
  ZIKV (strain MR 766) prME CDS mRNA wild type
gcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 96 - RNA, 1056 nt, Artificial Sequence
  ZIKV (strain MR 766) NS1 CDS mRNA wild type
gacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcg

SEQ ID NO: 97 - RNA, 678 nt, Artificial Sequence
  ZIKV (strain MR 766) NS2A CDS mRNA wild type
gggucaaccgaucauauggaccacuucucucuuggagugcuugugauucuacucauggugcaggagggguugaagaagagaaugaccacaaagaucaucaugagcacaucaauggcagugcugguagucaugaucuugggaggauuuucaaugagugaccuggccaagcuugugauccugaugggugcuacuuucgcagaaaugaacacuggaggagauguagcucacuuggcauugguagcggcauuuaaagucagaccagccuugcuggucuccuucauuuucagagccaauuggacaccccgugagagcaugcugcuagcccuggcuucgugucuucugcaaacugcgaucucugcucuugaaggugacuugaugguccucauuaauggauuugcuuuggccugguuggcaauucgagcaauggccgugccacgcacugacaacaucgcucuaccaaucuuggcugcucuaacaccacuagcucgaggcacacugcucguggcauggagagcgggccuggcuacuuguggagggaucaugcuccucucccugaaagggaaagguagugugaagaagaaccugccauuugucauggcccugggauugacagcugugaggguaguagacccuauuaaugugguaggacuacuguuacucacaaggagugggaagcgg

SEQ ID NO: 98 - RNA, 390 nt, Artificial Sequence
  ZIKV (strain MR 766) NS2B CDS mRNA wild type
agcuggcccccuagugaaguucucacagccguuggccugauaugugcacuggccggaggguuugccaaggcagacauugagauggcuggacccauggcugcaguaggcuugcuaauugucagcuauguggucucgggaaagaguguggacauguacauugaaagagcaggugacaucacaugggaaaaggacgcggaagucacuggaaacaguccucggcuugacguggcacuggaugagaguggugacuucuccuugguagaggaagaugguccacccaugagagagaucauacucaaggugguccugauggccaucuguggcaugaacccaauagcuauaccuuuugcugcaggagcgugguauguguaugugaagacugggaaaagg

SEQ ID NO: 99 - RNA, 1851 nt, Artificial Sequence
  ZIKV (strain MR 766) NS3 CDS mRNA wild type
aguggcgcccucugggacgugccugcucccaaagaagugaagaaaggagagaccacagauggaguguacagagugaugacucgcagacugcuagguucaacacagguuggagugggagucaugcaagagggagucuuccacaccauguggcacguuacaaaaggagccgcacugaggagcggugagggaagacuugauccauacuggggggaugucaagcaggacuuggugucauacugugggccuuggaaguuggaugcagcuugggauggacucagcgagguacagcuuuuggccguaccucccggagagagggccagaaacauucagacccugccuggaauauucaagacaaaggacggggacaucggagcaguugcucuggacuacccugcagggaccucaggaucuccgauccuagacaaauguggaagagugauaggacucuauggcaaugggguugugaucaagaauggaagcuauguuagugcuauaacccagggaaagagggaggaggagacuccgguugaauguuucgaacccucgaugcugaagaagaagcagcuaacugucuuggaucugcauccaggagccggaaaaaccaggagaguucuuccugaaauaguccgugaagccauaaaaaagagacuccggacagugaucuuggcaccaacuaggguugucgcugcugagauggaggaggccuugagaggacuuccggugcguuacaugacaacagcagucaacgucacccauucugggacagaaaucguugauuugaugugccaugccacuuucacuucacgcuuacuacaacccaucagagucccuaauuacaaucucaacaucauggaugaagcccacuucacagaccccucaaguauagcugcaagaggauacauaucaacaaggguugaaaugggcgaggcggcugccauuuuuaugacugccacaccaccaggaacccgugaugcguuuccugacucuaacucaccaaucauggacacagaaguggaagucccagagagagccuggagcucaggcuuugauugggugacagaccauucugggaaaacaguuugguucguuccaagcgugagaaacggaaaugaaaucgcagccugucugacaaaggcuggaaagcgggucauacagcucagcaggaagacuuuugagacagaauuucagaaaacaaaaaaucaagagugggacuuugucauaacaacugacaucucagagaugggcgccaacuucaaggcugaccgggucauagacucuaggagaugccuaaaaccagucauacuugauggugagagagucaucuuggcugggcccaugccugucacgcaugcuagugcugcucagaggagaggacguauaggcaggaacccuaacaaaccuggagaugaguacauguauggaggugggugugcagagacugaugaaggccaugcacacuggcuugaagcaagaaugcuucuugacaacaucuaccuccaggauggccucauagccucgcucuaucggccugaggccgauaagguagccgccauugagggagaguuuaagcugaggacagagcaaaggaagaccuucguggaacucaugaagagaggagaccuucccgucuggcuagccuaucagguugcaucugccggaauaacuuacacagacagaagauggugcuuugauggcacaaccaacaacaccauaauggaagacaguguaccagcagagguuuggacaaaguauggagagaagagagugcucaaaccgagauggauggaugcuagggucuguucagaccaugcggcccugaagucguucaaagaauucgccgcuggaaaaaga

SEQ ID NO: 100 - RNA, 450 nt, Artificial Sequence
  ZIKV (strain MR 766) NS4A CDS mRNA wild type
ggagcggcuuugggaguaauggaggcccugggaacacugccaggacacaugacagagagguuucaggaagccauugacaaccucgccgugcucaugcgagcagagacuggaagcaggccuuauaaggcagcggcagcccaacugccggagacccuagagaccauuaugcucuuagguuugcugggaacaguuucacuggggaucuucuucgucuugaugcggaauaagggcaucgggaagaugggcuuuggaaugguaacccuuggggccagugcauggcucauguggcuuucggaaauugaaccagccagaauugcauguguccucauuguuguguuuuuauuacugguggugcucauacccgagccagagaagcaaagaucuccccaagauaaccagauggcaauuaucaucaugguggcagugggccuucuagguuugauaacugca

SEQ ID NO: 101 - RNA, 753 nt, Artificial Sequence
  ZIKV (strain MR 766) NS4B CDS mRNA wild type
aacgaacuuggauggcuggaaagaacaaaaaaugacauagcucaucuaaugggaaggagagaagaaggagcaaccaugggauucucaauggacauugaucugcggccagccuccgccugggcuaucuaugccgcauugacaacucucaucaccccagcuguccaacaugcgguaaccacuucauacaacaacuacuccuuaauggcgauggccacacaagcuggagugcuguuuggcaugggcaaagggaugccauuuaugcauggggaccuuggagucccgcugcuaaugauggguugcuauucacaauuaacaccccugacucugauaguagcuaucauucugcuuguggcgcacuacauguacuugaucccaggccuacaagcggcagcagcgcgugcugcccagaaaaggacagcagcuggcaucaugaagaaucccguuguggauggaauagugguaacugacauugacacaaugacaauagacccccagguggagaagaagaugggacaaguguuacucauagcaguagccaucuccagugcugugcugcugcggaccgccuggggauggggggaggcuggagcucugaucacagcagcgaccuccaccuugugggaaggcucuccaaacaaauacuggaacuccucuacagccaccucacugugcaacaucuucagaggaagcuaucuggcaggagcuucccuuaucuauacagugacgagaaacgcuggccugguuaagagacgu

SEQ ID NO: 102 - RNA, 2709 nt, Artificial Sequence
  ZIKV (strain MR 766) NS5 CDS mRNA wild type
ggaggugggacgggagagacucugggagagaaguggaaagcucgucugaaucagaugucggcccuggaguucuacucuuauaaaaagucagguaucacugaaguguguagagaggaggcucgccgugcccucaaggauggaguggccacaggaggacaugccguaucccggggaagugcaaagaucagaugguuggaggagagaggauaucugcagcccuaugggaagguuguugaccucggauguggcagagggggcuggagcuauuaugccgccaccauccgcaaagugcaggaggugagaggauacacaaagggaggucccggucaugaagaacccaugcuggugcaaagcuauggguggaacauaguucgucucaagaguggaguggacgucuuccacauggcggcugagccgugugacacucugcugugugacauaggugagucaucaucuaguccugaaguggaagagacacgaacacucagagugcucucuauggugggggacuggcuugaaaaaagaccaggggccuucuguauaaaggugcugugcccauacaccagcacuaugauggaaaccauggagcgacugcaacguaggcaugggggaggauuagucagagugccauugugucgcaacuccacacaugagauguacugggucucuggggcaaagagcaacaucauaaaaaguguguccaccacaagucagcuccuccugggacgcauggauggccccaggaggccagugaaauaugaggaggaugugaaccucggcucggguacacgagcuguggcaagcugugcugaggcuccuaacaugaaaaucaucggcaggcgcauugagagaauccgcaaugaacaugcagaaacaugguuucuugaugaaaaccacccauacaggacaugggccuaccaugggagcuacgaagcccccacgcaaggaucagcgucuucccucgugaacgggguuguuagacuccugucaaagccuugggacguggugacuggaguuacaggaauagccaugacugacaccacaccauacggccaacaaagagucuucaaagaaaaaguggacaccagggugccagauccccaagaaggcacucgccagguaaugaacauagucucuuccuggcuguggaaggagcuggggaaacgcaagcggccacgcgucugcaccaaagaagaguuuaucaacaaggugcgcagcaaugcagcacugggagcaauauuugaagaggaaaaagaauggaagacggcuguggaagcugugaaugauccaagguuuugggcccuaguggauagggagagagaacaccaccugagaggagagugucacagcuguguguacaacaugaugggaaaaagagaaaagaagcaaggagaguucgggaaagcaaaagguagccgcgccaucugguacaugugguugggagccagauucuuggaguuugaagcccuuggauucuugaacgaggaccauuggaugggaagagaaaacucaggagguggagucgaaggguuaggauugcaaagacuuggauacauucuagaagaaaugaaucgggcaccaggaggaaagauguacgcagaugacacugcuggcugggacacccgcauuaguaaguuugaucuggagaaugaagcucugauuaccaaccaaauggaggaagggcacagaacucuggcguuggccgugauuaaauacacauaccaaaacaaaguggugaagguucucagaccagcugaaggaggaaaaacaguuauggacaucauuucaagacaagaccagagagggaguggacaaguugucacuuaugcucucaacacauucaccaacuugguggugcagcuuauccggaacauggaagcugaggaaguguuagagaugcaagacuuaugguuguugaggaagccagagaaagugaccagaugguugcagagcaauggaugggauagacucaaacgaauggcggucaguggagaugacugcguugugaagccaaucgaugauagguuugcacaugcccucagguucuugaaugacaugggaaaaguuaggaaagacacacaggaguggaaacccucgacuggauggagcaauugggaagaagucccguucugcucccaccacuucaacaagcuguaccucaaggaugggagauccauuguggucccuugccgccaccaagaugaacugauuggccgagcucgcgucucaccaggggcaggauggagcauccgggagacugccugucuugcaaaaucauaugcgcagauguggcagcuccuuuauuuccacagaagagaccuucgacugauggcuaaugccauuugcucggcugugccaguugacuggguaccaacugggagaaccaccuggucaauccauggaaagggagaauggaugaccacugaggacaugcucaugguguggaauagaguguggauugaggagaacgaccauauggaggacaagacuccuguaacaaaauggacagacauucccuaucuaggaaaaagggaggacuuaugguguggaucccuuauagggcacagaccccgcaccacuugggcugaaaacaucaaagacacagucaacauggugcgcaggaucauaggugaugaagaaaaguacauggacuaucuauccacccaaguccgcuacuugggugaggaaggguccacacccggaguguug

SEQ ID NO: 103 - RNA, 2124 nt, Artificial Sequence
  ZIKV (strain MR 766) Polyprotein(93-800) CDS mRNA wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaa

SEQ ID NO: 104 - RNA, 2124 nt, Artificial Sequence
  ZIKV (strain MR 766) Polyprotein(93-800) CDS mRNA wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaa

SEQ ID NO: 105 - RNA, 1341 nt, Artificial Sequence
  ZIKV (strain MR 766) Polyprotein(273-719) CDS mRNA wild type
agccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggauca

SEQ ID NO: 106 - RNA, 1341 nt, Artificial Sequence
  ZIKV (strain MR 766) Polyprotein(273-719) CDS mRNA wild type
agccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggauca

SEQ ID NO: 107 - RNA, 10269 nt, Artificial Sequence
  ZIKV (strain ZikaSPH2015) complete polyprotein CDS mRNA GC
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcggggagcaccgaccacauggaccacuucagccugggcguccucgugauccugcugauggugcaggaggggcucaagaagcgcaugacgaccaagaucaucaucuccaccagcauggccguccugguggccaugauccugggcggguucuccaugagcgaccucgccaagcuggccauccugaugggcgcgaccuucgccgagaugaacaccggcggggacguggcccaccucgcccugaucgccgcguucaagguccgccccgcccugcucguguccuucaucuuccgggccaacuggacgccccgcgagagcaugcugcuggcccucgcguccugccugcugcagaccgccaucagcgcccucgagggcgaccugauggugcugaucaacggguucgcccucgccuggcuggcgauccgggccauggucgugccgcgcaccgacaacaucacccuggccauccucgccgcccugacgccccuggcgcggggcacccuccugguggccuggcgcgccgggcuggccacgugcggcggcuucaugcuccugucccugaaggggaagggcagcgucaagaagaaccuccccuucgugauggcccuggggcugaccgcggugcggcucgucgaccccaucaacguggugggccugcugcuccugacgcgcuccgggaagcggagcuggccgcccuccgagguccugaccgccgugggccucaucugcgcccuggccggcggguucgcgaaggccgacaucgagauggccggccccauggccgccguggggcugcucaucgucagcuacgugguguccggcaagagcgucgacauguacaucgagcgcgcgggggacaucaccugggagaaggacgccgaggugaccggcaacuccccgcggcuggacguggcccuggacgagagcggcgacuucucccucgucgaggacgacgggccgcccaugcgcgagaucauccugaagguggugcugaugacgaucugcggcaugaaccccaucgccaucccguucgccgcgggggccugguacgucuacgugaagaccggcaagcggagcggcgcccugugggacgugcccgcccccaaggaggucaagaagggggagaccaccgacggcguguaccgcgugaugacgcggcgccuccuggggagcacccaggucggcgugggggugaugcaggagggcgucuuccacaccauguggcacgugaccaagggcuccgcccugcggagcggggagggccgccucgaccccuacuggggcgacgugaagcaggaccuggucuccuacugcgggccguggaagcuggacgcggccugggacgggcacagcgaggugcagcuccuggccgugcccccgggcgagcgggcccgcaacauccagacgcugcccggcaucuucaagaccaaggacggggacaucggcgcggucgcccucgacuacccggccgggaccuccggcagccccauccuggacaagugcgggcgcgugaucggccuguacggcaacgggguggucaucaagaacggcuccuacgugagcgccaucacccaggggcggcgcgaggaggagacgcccgucgagugcuucgagcccuccaugcucaagaagaagcagcugaccgugcuggaccuccacccgggcgccgggaagacccggcgcgugcugcccgagaucguccgggaggcgaucaagacccgccugcggacggugauccucgcccccacccgcguggucgccgccgagauggaggaggcccugcggggccugcccgugcgcuacaugaccaccgcggugaacgucacgcacagcggcaccgagaucguggaccucaugugccacgccaccuucaccucccggcugcugcagccgauccgcgugcccaacuacaaccucuacaucauggacgaggcccacuucacggaccccagcuccaucgccgcccggggguacaucagcacccgcgucgagaugggcgaggcggccgccaucuucaugaccgccaccccgccggggacccgggacgccuuccccgacuccaacagccccaucauggacacggagguggaggugcccgagcgcgcgugguccagcggcuucgacugggucaccgacuacuccggcaagaccgugugguucgugccgagcguccggaacgggaacgagaucgccgccugccugaccaaggccggcaagcgcgugauccagcugagccggaagacguucgagaccgaguuccagaagaccaagcaccaggagugggacuucguggucaccacggacaucuccgagaugggggcgaacuucaaggccgaccgcgugaucgacagccggcgcugccucaagcccgugauccuggacggcgagcgcgucauccuggccgggcccaugcccgugacccacgccuccgccgcgcagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgccagccucuaccgccccgaggcggacaagguggccgccaucgagggcgaguucaagcugcggaccgagcagcgcaagacguucgucgagcugaugaagcggggcgaccucccgguguggcuggccuaccagguggccuccgcggggaucaccuacaccgaccgccgguggugcuucgacggcaccacgaacaacaccaucauggaggacagcguccccgccgagguguggacccgccacggggagaagcgggugcugaagccccgcuggauggacgcccgggucugcuccgaccacgccgcgcucaagagcuucaaggaguucgccgccggcaagcgcggggccgccuucggcgugauggaggcgcugggcacccugcccgggcacaugacggagcgguuccaggaggccaucgacaaccucgccgugcugaugcgcgccgagaccggcucccggccguacaaggccgcggccgcccagcugcccgagacccucgagaccaucaugcugcuggggcuccugggcacggucagccugggcaucuucuucgugcucaugcgcaacaaggggaucggcaagaugggguucggcauggugacccugggggccuccgccuggcugauguggcucagcgagaucgagcccgcgcgcaucgccugcguccugaucgugguguuccugcuccuggucgugcugauccccgagccggagaagcagcgguccccgcaggacaaccagauggccaucaucaucaugguggccgucggccuccugggccugaucaccgcgaacgagcucggguggcuggagcgcaccaagagcgaccugucccaccucaugggccggcgcgaggagggggccacgaugggcuucagcauggacaucgaccugcggcccgccuccgccugggccaucuacgcggcccugaccaccuucaucacccccgccgugcagcacgccgugacgaccagcuacaacaacuacucccucauggccauggcgacccaggccgggguccuguucggcaugggcaaggggaugccguucuacgccugggacuucggcgugccgcugcucaugaucgggugcuacagccagcugaccccgcugacgcucaucguggccaucauccugcuggucgcccacuacauguaccucauccccggccugcaggcggccgccgcccgcgccgcgcagaagcggaccgccgccgggaucaugaagaacccgguggucgacggcaucguggugaccgacaucgacaccaugacgaucgacccccaggucgagaagaagaugggccaggugcugcucauggccguggcggucagcuccgccauccugagccgcaccgccuggggguggggcgaggccggggcccugaucaccgcggccaccuccacccucugggagggcagccccaacaaguacuggaacuccagcacggccaccucccugugcaacaucuuccgggggagcuaccuggccggcgccucccucaucuacaccgugacccgcaacgcgggccuggugaagcggcgcgggggcgggacgggcgagacccugggcgagaaguggaaggcccggcucaaccagaugagcgcccuggaguucuacuccuacaagaagagcgggaucaccgaggucugccgcgaggaggcccggcgcgcccugaaggacggcguggcgaccgggggccacgccgugucccgggggagcgccaagcuccgcuggcuggucgagcggggcuaccugcagcccuacggcaaggugaucgaccuggggugcggccgcgggggcugguccuacuacgccgcgacgauccggaaggugcaggaggucaagggguacaccaagggcggcccggggcacgaggagcccgugcucgugcagagcuacggcuggaacaucguccgccugaaguccgggguggacguguuccacauggccgccgagcccugcgacacccugcucugcgacaucggcgagagcuccagcagccccgaggucgaggaggcccgcacccugcgggugcuguccauggugggggacuggcucgagaagcgcccgggcgccuucugcaucaagguccugugccccuacacgagcaccaugauggagacccuggagcggcuccagcgccgguacggcgggggccuggugcgcgugccccugucccggaacagcacccacgagauguacugggucuccggggcgaagagcaacacgaucaaguccgugagcaccaccucccagcuccugcugggccgcauggacggcccccggcgcccggugaaguacgaggaggacgucaaccucgggagcggcacccgggccgugguguccugcgccgaggcccccaacaugaagaucaucgggaaccgcaucgagcggauccgcagcgagcacgccgagacgugguucuucgacgagaaccaccccuaccggaccugggcguaccacggcuccuacgaggccccgacccaggggagcgccuccagccugaucaacggcgucgugcgccugcucuccaagcccugggacguggucaccggcgugacggggaucgccaugaccgacaccacccccuacggccagcagcggguguucaaggagaaggucgacacgcgcgugcccgacccgcaggaggggacccgccaggugaugagcauggucagcuccuggcuguggaaggagcugggcaagcacaagcgcccccgcgugugcaccaaggaggaguucaucaacaaggugcggagcaacgccgcgcucggggccaucuucgaggaggagaaggaguggaagaccgccgucgaggccgugaacgacccccgcuucugggcccugguggacaaggagcgggagcaccaccuccgcggcgagugccaguccugcgucuacaacaugaugggcaagcgggagaagaagcagggggaguucggcaaggcgaaggggagccgcgccaucugguacauguggcucggcgcccgguuccuggaguucgaggcccugggguuccucaacgaggaccacuggaugggccgcgagaacuccggcgggggcguggaggggcugggccugcagcggcucggguacgugcuggaggagaugagccgcauccccggcggccggauguacgcggacgacacggccgggugggacacccgcaucucccgguucgaccuggagaacgaggcccucaucaccaaccagauggagaagggccaccgcgcccuggcccuggcgaucaucaaguacaccuaccagaacaaggucgugaagguccuccggccggccgagaaggggaagacggugauggacaucaucagccgccaggaccagcggggcuccggccagguggucaccuacgcccugaacaccuucaccaaccugguggugcagcucauccgcaacauggaggccgaggagguccuggagaugcaggaccuguggcuccugcggcgcagcgagaaggugaccaacuggcugcaguccaacgggugggaccggcucaagcgcauggccgugagcggcgacgacugcgucgugaagcccaucgacgaccgcuucgcgcacgcccugcgguuccugaacgacauggggaaggugcgcaaggacacgcaggaguggaagcccuccaccggcugggacaacugggaggagguccccuucugcagccaccacuucaacaagcuccaccugaaggacgggcgguccaucguggugccgugccgccaccaggacgagcugaucggccgggcccgcgucagccccggcgccgggugguccauccgggagaccgccugccucgcgaagagcuacgcccagauguggcagcugcuguacuuccaccgccgggaccuccgccugauggccaacgccaucugcuccagcgugcccguggacuggguccccaccggccggacgaccuggagcauccacgggaagggcgaguggaugaccaccgaggacaugcuggugguguggaaccgcgucuggaucgaggagaacgaccacauggaggacaagacgccggugaccaaguggaccgacauccccuaccucgggaagcgggaggaccuguggugcggcucccugaucggccaccgcccccggaccacgugggcggagaacaucaagaacaccgugaacaugguccgccggaucaucggggacgaggagaaguacauggacuaccucagcacccaggugcgcuaccugggcgaggagggguccacccccggcgugcug

SEQ ID NO: 108 - RNA, 312 nt, Artificial Sequence
  ZIKV (strain ZikaSPH2015) C CDS mRNA GC
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgc

SEQ ID NO: 109 - RNA, 366 nt, Artificial Sequence
  ZIKV (strain ZikaSPH2015) C-ER anchor CDS mRNA GC
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcg

SEQ ID NO: 110 - RNA, 279 nt, Artificial Sequence
  ZIKV (strain ZikaSPH2015) pr CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgg

SEQ ID NO: 111 - RNA, 225 nt, Artificial Sequence
  ZIKV (strain ZikaSPH2015) M CDS mRNA GC
gccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacucc

SEQ ID NO: 112 - RNA, 504 nt, Artificial Sequence
  ZIKV (strain ZikaSPH2015) prM CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacucc

SEQ ID NO: 113 - RNA, 1512 nt, Artificial Sequence
  ZIKV (strain ZikaSPH2015) E CDS mRNA GC
auccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 114 - RNA, 2016 nt, Artificial Sequence
  ZIKV (strain ZikaSPH2015) prME CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 115 - RNA, 1056 nt, Artificial Sequence
  ZIKV (strain ZikaSPH2015) NS1 CDS mRNA GC
gacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcg

SEQ ID NO: 116 - RNA, 678 nt, Artificial Sequence
  ZIKV (strain ZikaSPH2015) NS2A CDS mRNA GC
gggagcaccgaccacauggaccacuucagccugggcguccucgugauccugcugauggugcaggaggggcucaagaagcgcaugacgaccaagaucaucaucuccaccagcauggccguccugguggccaugauccugggcggguucuccaugagcgaccucgccaagcuggccauccugaugggcgcgaccuucgccgagaugaacaccggcggggacguggcccaccucgcccugaucgccgcguucaagguccgccccgcccugcucguguccuucaucuuccgggccaacuggacgccccgcgagagcaugcugcuggcccucgcguccugccugcugcagaccgccaucagcgcccucgagggcgaccugauggugcugaucaacggguucgcccucgccuggcuggcgauccgggccauggucgugccgcgcaccgacaacaucacccuggccauccucgccgcccugacgccccuggcgcggggcacccuccugguggccuggcgcgccgggcuggccacgugcggcggcuucaugcuccugucccugaaggggaagggcagcgucaagaagaaccuccccuucgugauggcccuggggcugaccgcggugcggcucgucgaccccaucaacguggugggccugcugcuccugacgcgcuccgggaagcgg

SEQ ID NO: 117 - RNA, 390 nt, Artificial Sequence
  ZIKV (strain ZikaSPH2015) NS2B CDS mRNA GC
agcuggccgcccuccgagguccugaccgccgugggccucaucugcgcccuggccggcggguucgcgaaggccgacaucgagauggccggccccauggccgccguggggcugcucaucgucagcuacgugguguccggcaagagcgucgacauguacaucgagcgcgcgggggacaucaccugggagaaggacgccgaggugaccggcaacuccccgcggcuggacguggcccuggacgagagcggcgacuucucccucgucgaggacgacgggccgcccaugcgcgagaucauccugaagguggugcugaugacgaucugcggcaugaaccccaucgccaucccguucgccgcgggggccugguacgucuacgugaagaccggcaagcgg

SEQ ID NO: 118 - RNA, 1851 nt, Artificial Sequence
  ZIKV (strain ZikaSPH2015) NS3 CDS mRNA GC
agcggcgcccugugggacgugcccgcccccaaggaggucaagaagggggagaccaccgacggcguguaccgcgugaugacgcggcgccuccuggggagcacccaggucggcgugggggugaugcaggagggcgucuuccacaccauguggcacgugaccaagggcuccgcccugcggagcggggagggccgccucgaccccuacuggggcgacgugaagcaggaccuggucuccuacugcgggccguggaagcuggacgcggccugggacgggcacagcgaggugcagcuccuggccgugcccccgggcgagcgggcccgcaacauccagacgcugcccggcaucuucaagaccaaggacggggacaucggcgcggucgcccucgacuacccggccgggaccuccggcagccccauccuggacaagugcgggcgcgugaucggccuguacggcaacgggguggucaucaagaacggcuccuacgugagcgccaucacccaggggcggcgcgaggaggagacgcccgucgagugcuucgagcccuccaugcucaagaagaagcagcugaccgugcuggaccuccacccgggcgccgggaagacccggcgcgugcugcccgagaucguccgggaggcgaucaagacccgccugcggacggugauccucgcccccacccgcguggucgccgccgagauggaggaggcccugcggggccugcccgugcgcuacaugaccaccgcggugaacgucacgcacagcggcaccgagaucguggaccucaugugccacgccaccuucaccucccggcugcugcagccgauccgcgugcccaacuacaaccucuacaucauggacgaggcccacuucacggaccccagcuccaucgccgcccggggguacaucagcacccgcgucgagaugggcgaggcggccgccaucuucaugaccgccaccccgccggggacccgggacgccuuccccgacuccaacagccccaucauggacacggagguggaggugcccgagcgcgcgugguccagcggcuucgacugggucaccgacuacuccggcaagaccgugugguucgugccgagcguccggaacgggaacgagaucgccgccugccugaccaaggccggcaagcgcgugauccagcugagccggaagacguucgagaccgaguuccagaagaccaagcaccaggagugggacuucguggucaccacggacaucuccgagaugggggcgaacuucaaggccgaccgcgugaucgacagccggcgcugccucaagcccgugauccuggacggcgagcgcgucauccuggccgggcccaugcccgugacccacgccuccgccgcgcagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgccagccucuaccgccccgaggcggacaagguggccgccaucgagggcgaguucaagcugcggaccgagcagcgcaagacguucgucgagcugaugaagcggggcgaccucccgguguggcuggccuaccagguggccuccgcggggaucaccuacaccgaccgccgguggugcuucgacggcaccacgaacaacaccaucauggaggacagcguccccgccgagguguggacccgccacggggagaagcgggugcugaagccccgcuggauggacgcccgggucugcuccgaccacgccgcgcucaagagcuucaaggaguucgccgccggcaagcgc

SEQ ID NO: 119 - RNA, 450 nt, Artificial Sequence
  ZIKV (strain ZikaSPH2015) NS4A CDS mRNA GC
ggggccgccuucggcgugauggaggcgcugggcacccugcccgggcacaugacggagcgguuccaggaggccaucgacaaccucgccgugcugaugcgcgccgagaccggcucccggccguacaaggccgcggccgcccagcugcccgagacccucgagaccaucaugcugcuggggcuccugggcacggucagccugggcaucuucuucgugcucaugcgcaacaaggggaucggcaagaugggguucggcauggugacccugggggccuccgccuggcugauguggcucagcgagaucgagcccgcgcgcaucgccugcguccugaucgugguguuccugcuccuggucgugcugauccccgagccggagaagcagcgguccccgcaggacaaccagauggccaucaucaucaugguggccgucggccuccugggccugaucaccgcg

SEQ ID NO: 120 - RNA, 753 nt, Artificial Sequence
  ZIKV (strain ZikaSPH2015) NS4B CDS mRNA GC
aacgagcucggguggcuggagcgcaccaagagcgaccugucccaccucaugggccggcgcgaggagggggccacgaugggcuucagcauggacaucgaccugcggcccgccuccgccugggccaucuacgcggcccugaccaccuucaucacccccgccgugcagcacgccgugacgaccagcuacaacaacuacucccucauggccauggcgacccaggccgggguccuguucggcaugggcaaggggaugccguucuacgccugggacuucggcgugccgcugcucaugaucgggugcuacagccagcugaccccgcugacgcucaucguggccaucauccugcuggucgcccacuacauguaccucauccccggccugcaggcggccgccgcccgcgccgcgcagaagcggaccgccgccgggaucaugaagaacccgguggucgacggcaucguggugaccgacaucgacaccaugacgaucgacccccaggucgagaagaagaugggccaggugcugcucauggccguggcggucagcuccgccauccugagccgcaccgccuggggguggggcgaggccggggcccugaucaccgcggccaccuccacccucugggagggcagccccaacaaguacuggaacuccagcacggccaccucccugugcaacaucuuccgggggagcuaccuggccggcgccucccucaucuacaccgugacccgcaacgcgggccuggugaagcggcgc

SEQ ID NO: 121 - RNA, 2709 nt, Artificial Sequence
  ZIKV (strain ZikaSPH2015) NS5 CDS mRNA GC
gggggcgggacgggcgagacccugggcgagaaguggaaggcccggcucaaccagaugagcgcccuggaguucuacuccuacaagaagagcgggaucaccgaggucugccgcgaggaggcccggcgcgcccugaaggacggcguggcgaccgggggccacgccgugucccgggggagcgccaagcuccgcuggcuggucgagcggggcuaccugcagcccuacggcaaggugaucgaccuggggugcggccgcgggggcugguccuacuacgccgcgacgauccggaaggugcaggaggucaagggguacaccaagggcggcccggggcacgaggagcccgugcucgugcagagcuacggcuggaacaucguccgccugaaguccgggguggacguguuccacauggccgccgagcccugcgacacccugcucugcgacaucggcgagagcuccagcagccccgaggucgaggaggcccgcacccugcgggugcuguccauggugggggacuggcucgagaagcgcccgggcgccuucugcaucaagguccugugccccuacacgagcaccaugauggagacccuggagcggcuccagcgccgguacggcgggggccuggugcgcgugccccugucccggaacagcacccacgagauguacugggucuccggggcgaagagcaacacgaucaaguccgugagcaccaccucccagcuccugcugggccgcauggacggcccccggcgcccggugaaguacgaggaggacgucaaccucgggagcggcacccgggccgugguguccugcgccgaggcccccaacaugaagaucaucgggaaccgcaucgagcggauccgcagcgagcacgccgagacgugguucuucgacgagaaccaccccuaccggaccugggcguaccacggcuccuacgaggccccgacccaggggagcgccuccagccugaucaacggcgucgugcgccugcucuccaagcccugggacguggucaccggcgugacggggaucgccaugaccgacaccacccccuacggccagcagcggguguucaaggagaaggucgacacgcgcgugcccgacccgcaggaggggacccgccaggugaugagcauggucagcuccuggcuguggaaggagcugggcaagcacaagcgcccccgcgugugcaccaaggaggaguucaucaacaaggugcggagcaacgccgcgcucggggccaucuucgaggaggagaaggaguggaagaccgccgucgaggccgugaacgacccccgcuucugggcccugguggacaaggagcgggagcaccaccuccgcggcgagugccaguccugcgucuacaacaugaugggcaagcgggagaagaagcagggggaguucggcaaggcgaaggggagccgcgccaucugguacauguggcucggcgcccgguuccuggaguucgaggcccugggguuccucaacgaggaccacuggaugggccgcgagaacuccggcgggggcguggaggggcugggccugcagcggcucggguacgugcuggaggagaugagccgcauccccggcggccggauguacgcggacgacacggccgggugggacacccgcaucucccgguucgaccuggagaacgaggcccucaucaccaaccagauggagaagggccaccgcgcccuggcccuggcgaucaucaaguacaccuaccagaacaaggucgugaagguccuccggccggccgagaaggggaagacggugauggacaucaucagccgccaggaccagcggggcuccggccagguggucaccuacgcccugaacaccuucaccaaccugguggugcagcucauccgcaacauggaggccgaggagguccuggagaugcaggaccuguggcuccugcggcgcagcgagaaggugaccaacuggcugcaguccaacgggugggaccggcucaagcgcauggccgugagcggcgacgacugcgucgugaagcccaucgacgaccgcuucgcgcacgcccugcgguuccugaacgacauggggaaggugcgcaaggacacgcaggaguggaagcccuccaccggcugggacaacugggaggagguccccuucugcagccaccacuucaacaagcuccaccugaaggacgggcgguccaucguggugccgugccgccaccaggacgagcugaucggccgggcccgcgucagccccggcgccgggugguccauccgggagaccgccugccucgcgaagagcuacgcccagauguggcagcugcuguacuuccaccgccgggaccuccgccugauggccaacgccaucugcuccagcgugcccguggacuggguccccaccggccggacgaccuggagcauccacgggaagggcgaguggaugaccaccgaggacaugcuggugguguggaaccgcgucuggaucgaggagaacgaccacauggaggacaagacgccggugaccaaguggaccgacauccccuaccucgggaagcgggaggaccuguggugcggcucccugaucggccaccgcccccggaccacgugggcggagaacaucaagaacaccgugaacaugguccgccggaucaucggggacgaggagaaguacauggacuaccucagcacccaggugcgcuaccugggcgaggagggguccacccccggcgugcug

SEQ ID NO: 122 - RNA, 2136 nt, Artificial Sequence
  ZIKV (strain ZikaSPH2015) Polyprotein(93-804) CDS mRNA GC
cggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 123 - RNA, 2136 nt, Artificial Sequence
  ZIKV (strain ZikaSPH2015) Polyprotein(93-804) CDS mRNA GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacaucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcaccccgcacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcacggcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgccguucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccugaacucccucgggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaag

SEQ ID NO: 124 - RNA, 1353 nt, Artificial Sequence
  ZIKV (strain ZikaSPH2015) Polyprotein(273-723) CDS mRNA GC
agccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagc

SEQ ID NO: 125 - RNA, 1353 nt, Artificial Sequence
  ZIKV (strain ZikaSPH2015) Polyprotein(273-723) CDS mRNA GC
agccagaaggugaucuaccuggucaugauccuccugaucgcccccgccuacuccauccgcugcaucggcgugagcaaccgggacuucguggaggggauguccggcgggaccugggucgacaucgugcuggagcacggcgggugcgugaccgucauggcgcaggacaagccgacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcucuucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaacccggugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcucc

SEQ ID NO: 126 - RNA, 10269 nt, Artificial Sequence
  ZIKV (isolate Z1106033) complete polyprotein CDS mRNA GC
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgccgggagcaccgaccacauggaccacuucagccugggcgugcucgugauccugcugaugguccaggaggggcucaagaagcgcaugacgaccaagaucaucaucuccaccagcauggccgugcugguggccaugauccugggcggguucuccaugagcgaccucgccaagcuggcgauccugaugggcgccaccuucgccgagaugaacaccggcggggacgucgcccaccucgcccugaucgcggccuucaaggugcgccccgcccugcucguguccuucaucuuccgggccaacuggacgccccgcgagagcaugcugcuggcgcucgccuccugccugcugcagaccgccaucagcgcccucgagggcgaccugaugguccugaucaacggguucgcccucgcguggcuggccauccgggccaugguggugccgcgcaccgacaacaucacccuggccauccucgccgcgcugacgccccuggcccggggcacccuccuggucgccuggcgcgccgggcuggccacgugcggcggcuucaugcuccugucccugaaggggaagggcagcgugaagaagaaccuccccuucgugauggcgcuggggcugaccgccguccggcucguggaccccaucaacguggucggccugcugcuccugacgcgcuccgggaagcggagcuggccgcccuccgaggugcugaccgccgugggccucaucugcgcccuggcgggcggguucgccaaggccgacaucgagauggccggccccauggccgcggucgggcugcucaucgugagcuacguggucuccggcaagagcguggacauguacaucgagcgcgccggggacaucaccugggagaaggacgccgaggugaccggcaacuccccgcggcuggacgucgcccuggacgagagcggcgacuucucccucguggaggacgacgggccgcccaugcgcgagaucauccugaaggugguccugaugacgaucugcggcaugaaccccaucgccaucccguucgcggccggggccugguacguguacgugaagaccggcaagcggagcggcgcccugugggacguccccgcccccaaggaggugaagaagggggagaccaccgacggcguguaccgcgucaugacgcggcgccuccuggggagcacccaggugggcgugggggucaugcaggagggcguguuccacaccauguggcacgugaccaagggcuccgcgcugcggagcggggagggccgccucgaccccuacuggggcgacgucaagcaggaccugguguccuacugcgggccguggaagcuggacgccgccugggacgggcacagcgaggugcagcuccuggccgucccgcccggcgagcgggcgcgcaacauccagacgcugcccggcaucuucaagaccaaggacggggacaucggcgccguggcccucgacuacccggccgggaccuccggcagccccauccuggacaagugcgggcgcgugaucggccuguacggcaacggggucgugaucaagaacggcuccuacgucagcgccaucacccaggggcggcgcgaggaggagacgcccguggagugcuucgagcccuccaugcucaagaagaagcagcugaccgugcuggaccuccacccgggcgcggggaagacccggcgcguccugcccgagaucgugcgggaggccaucaagacccgccugcggacggugauccucgcccccacccgcgucguggccgccgagauggaggaggcgcugcggggccugcccgugcgcuacaugaccaccgccgucaacgugacgcacagcggcaccgagaucguggaccucaugugccacgccaccuucaccucccggcugcugcagccgauccgcguccccaacuacaaccucuacaucauggacgaggcccacuucacggaccccagcuccaucgccgcgcggggguacaucagcacccgcguggagaugggcgaggccgccgccaucuucaugaccgccaccccgccggggacccgggacgcguuccccgacuccaacagccccaucauggacacggagguggagguccccgagcgcgccugguccagcggcuucgacugggugaccgaccacuccggcaagaccgugugguucgucccgagcgugcggaacgggaacgagaucgccgccugccugaccaaggcgggcaagcgcgugauccagcugagccggaagacguucgagaccgaguuccagaagaccaagcaccaggagugggacuucgucgugaccacggacaucuccgagaugggggccaacuucaaggccgaccgcgugaucgacagccggcgcugccucaagcccgucauccuggacggcgagcgcgugauccuggccgggcccaugcccgugacccacgccuccgcggcccagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgcgagccucuaccgccccgaggccgacaaggucgccgccaucgagggcgaguucaagcugcggaccgagcagcgcaagacguucguggagcugaugaagcggggcgaccucccgguguggcuggccuaccaggucgcguccgccgggaucaccuacaccgaccgccgguggugcuucgacggcaccacgaacaacaccaucauggaggacagcgugcccgccgagguguggacccgccacggggagaagcggguccugaagccccgcuggauggacgcccgggugugcuccgaccacgcggcccucaagagcuucaaggaguucgccgccggcaagcgcggggccgcguucggcgugauggaggcccugggcacccugcccgggcacaugacggagcgguuccaggaggccaucgacaaccucgccguccugaugcgcgccgagaccggcucccggccguacaaggcggccgccgcccagcugcccgagacccucgagaccaucaugcugcuggggcuccugggcacggugagccugggcaucuucuucgugcucaugcgcaacaaggggaucggcaagaugggguucggcauggucacccugggggccuccgcguggcugauguggcucagcgagaucgagcccgcccgcaucgccugcgugcugaucguggucuuccugcuccugguggugcugauccccgagccggagaagcagcgguccccgcaggacaaccagauggccaucaucaucauggucgcggugggccuccugggccugaucaccgccaacgagcucggguggcuggagcgcaccaagagcgaccugucccaccucaugggccggcgcgaggagggggccacgaucggcuucagcauggacaucgaccugcggcccgccuccgccugggcgaucuacgccgcccugaccaccuucaucacccccgccgugcagcacgccgucacgaccagcuacaacaacuacucccucauggcgauggccacccaggccggggugcuguucggcaugggcaaggggaugccguucuacgccugggacuucggcgugccccugcucaugaucgggugcuacagccagcugaccccgcugacgcucaucgucgccaucauccugcugguggcgcacuacauguaccucauccccggccugcaggccgccgccgcccgcgcggcccagaagcggaccgccgccgggaucaugaagaacccggucguggacggcaucguggucaccgacaucgacaccaugacgaucgacccccagguggagaagaagaugggccaggugcugcucaucgcggucgccgugagcuccgccauccugagccgcaccgccuggggguggggcgaggccggggcgcugaucaccgccgccaccuccacccucugggagggcagccccaacaaguacuggaacuccagcacggccaccucccugugcaacaucuuccgggggagcuaccuggccggcgcgucccucaucuacaccgugacccgcaacgccggccuggucaagcggcgcgggggcgggacgggcgagacccugggcgagaaguggaaggcccggcucaaccagaugagcgcccuggaguucuacuccuacaagaagagcgggaucaccgaggugugccgcgaggaggcccggcgcgcgcugaaggacggcguggccaccgggggccacgccgucucccgggggagcgccaagcuccgcuggcugguggagcggggcuaccugcagcccuacggcaaggugaucgaccuggggugcggccgcgggggcugguccuacuacgcggccacgauccggaagguccaggaggugaagggguacaccaagggcggcccggggcacgaggagcccgugcucguccagagcuacggcuggaacaucgugcgccugaaguccgggguggacgucuuccacauggccgccgagcccugcgacacccugcucugcgacaucggcgagagcuccagcagccccgagguggaggaggcccgcacccugcgggugcuguccauggucggggacuggcucgagaagcgcccgggcgcguucugcaucaaggugcugugccccuacacgagcaccaugauggagacccuggagcggcuccagcgccgguacggcgggggccuggugcgcgucccccugucccggaacagcacccacgagauguacuggguguccggggccaagagcaacacgaucaaguccgugagcaccaccucccagcuccugcugggccgcauggacggcccccggcgcccggucaaguacgaggaggacgugaaccucgggagcggcacccgggccguggucuccugcgccgaggcccccaacaugaagaucaucgggaaccgcaucgagcggauccgcagcgagcacgcggagacgugguucuucgacgagaaccaccccuaccggaccugggccuaccacggcuccuacgaggccccgacccaggggagcgccuccagccugaucaacggcguggugcgccugcucuccaagcccugggacgucgugaccggcgugacggggaucgccaugaccgacaccacccccuacggccagcagcgggucuucaaggagaagguggacacgcgcgugcccgacccgcaggaggggacccggcaggucaugagcauggugagcuccuggcuguggaaggagcugggcaagcacaagcgcccccgcgugugcaccaaggaggaguucaucaacaagguccggagcaacgcggcccucggggccaucuucgaggaggagaaggaguggaagaccgccguggaggccgugaacgacccccgcuucugggcgcuggucgacaaggagcgggagcaccaccuccgcggcgagugccaguccugcguguacaacaugaugggcaagcgggagaagaagcagggggaguucggcaaggccaaggggagccgcgccaucugguacauguggcucggcgcccgguuccuggaguucgaggcgcugggguuccucaacgaggaccacuggaugggccgcgagaacuccggcgggggcguggaggggcugggccugcagcggcucggguacguccuggaggagaugagccgcauccccggcggccggauguacgccgacgacacggccgggugggacacccgcaucucccgguucgaccuggagaacgaggcccucaucaccaaccagauggagaagggccaccgcgcccuggcgcuggccaucaucaaguacaccuaccagaacaagguggucaaggugcuccggccggccgagaaggggaagacggugauggacaucaucagccgccaggaccagcggggcuccggccaggucgugaccuacgcccugaacaccuucaccaaccuggugguccagcucauccgcaacauggaggccgaggaggugcuggagaugcaggaccuguggcuccugcggcgcagcgagaaggugaccaacuggcugcaguccaacgggugggaccggcucaagcgcauggcggucagcggcgacgacugcguggugaagcccaucgacgaccgcuucgcccacgcccugcgguuccugaacgacauggggaagguccgcaaggacacgcaggaguggaagcccuccaccggcugggacaacugggaggaggugcccuucugcagccaccacuucaacaagcuccaccugaaggacgggcgguccaucguggucccgugccgccaccaggacgagcugaucggccgggcccgcgugagccccggcgccgggugguccauccgggagaccgcgugccucgccaagagcuacgcccagauguggcagcugcuguacuuccaccgccgggaccuccgccugauggccaacgcgaucugcuccagcgugcccgucgacugggugcccaccggccggacgaccuggagcauccacgggaagggcgaguggaugaccaccgaggacaugcugguggucuggaaccgcguguggaucgaggagaacgaccacauggaggacaagacgccggugaccaaguggaccgacauccccuaccucgggaagcgggaggaccuguggugcggcucccugaucggccaccgcccccggaccacgugggccgagaacaucaagaacaccgucaacauggugcgccggaucaucggggacgaggagaaguacauggacuaccucagcacccaggugcgcuaccugggcgaggagggguccacccccggcguccug

SEQ ID NO: 127 - RNA, 312 nt, Artificial Sequence; identical to SEQ ID NO: 108
  ZIKV (isolate Z1106033) C CDS mRNA GC

SEQ ID NO: 128 - RNA, 366 nt, Artificial Sequence; identical to SEQ ID NO: 109
  ZIKV (isolate Z1106033) C-ER anchor CDS mRNA GC

SEQ ID NO: 129 - RNA, 279 nt, Artificial Sequence
  ZIKV (isolate Z1106033) pr CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgg

SEQ ID NO: 130 - RNA, 225 nt, Artificial Sequence
  ZIKV (isolate Z1106033) M CDS mRNA GC
gccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacucc

SEQ ID NO: 131 - RNA, 504 nt, Artificial Sequence
  ZIKV (isolate Z1106033) prM CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacucc

SEQ ID NO: 132 - RNA, 1512 nt, Artificial Sequence
  ZIKV (isolate Z1106033) E CDS mRNA GC
auccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 133 - RNA, 2016 nt, Artificial Sequence
  ZIKV (isolate Z1106033) prME CDS mRNA GC
gccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 134 - RNA, 1056 nt, Artificial Sequence
  ZIKV (isolate Z1106033) NS1 CDS mRNA GC
gacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgcc

SEQ ID NO: 135 - RNA, 678 nt, Artificial Sequence
  ZIKV (isolate Z1106033) NS2A CDS mRNA GC
gggagcaccgaccacauggaccacuucagccugggcgugcucgugauccugcugaugguccaggaggggcucaagaagcgcaugacgaccaagaucaucaucuccaccagcauggccgugcugguggccaugauccugggcggguucuccaugagcgaccucgccaagcuggcgauccugaugggcgccaccuucgccgagaugaacaccggcggggacgucgcccaccucgcccugaucgcggccuucaaggugcgccccgcccugcucguguccuucaucuuccgggccaacuggacgccccgcgagagcaugcugcuggcgcucgccuccugccugcugcagaccgccaucagcgcccucgagggcgaccugaugguccugaucaacggguucgcccucgcguggcuggccauccgggccaugguggugccgcgcaccgacaacaucacccuggccauccucgccgcgcugacgccccuggcccggggcacccuccuggucgccuggcgcgccgggcuggccacgugcggcggcuucaugcuccugucccugaaggggaagggcagcgugaagaagaaccuccccuucgugauggcgcuggggcugaccgccguccggcucguggaccccaucaacguggucggccugcugcuccugacgcgcuccgggaagcgg

SEQ ID NO: 136 - RNA, 390 nt, Artificial Sequence
  ZIKV (isolate Z1106033) NS2B CDS mRNA GC
agcuggccgcccuccgaggugcugaccgccgugggccucaucugcgcccuggcgggcggguucgccaaggccgacaucgagauggccggccccauggccgcggucgggcugcucaucgugagcuacguggucuccggcaagagcguggacauguacaucgagcgcgccggggacaucaccugggagaaggacgccgaggugaccggcaacuccccgcggcuggacgucgcccuggacgagagcggcgacuucucccucguggaggacgacgggccgcccaugcgcgagaucauccugaaggugguccugaugacgaucugcggcaugaaccccaucgccaucccguucgcggccggggccugguacguguacgugaagaccggcaagcgg

SEQ ID NO: 137 - RNA, 1851 nt, Artificial Sequence
  ZIKV (isolate Z1106033) NS3 CDS mRNA GC
agcggcgcccugugggacguccccgcccccaaggaggugaagaagggggagaccaccgacggcguguaccgcgucaugacgcggcgccuccuggggagcacccaggugggcgugggggucaugcaggagggcguguuccacaccauguggcacgugaccaagggcuccgcgcugcggagcggggagggccgccucgaccccuacuggggcgacgucaagcaggaccugguguccuacugcgggccguggaagcuggacgccgccugggacgggcacagcgaggugcagcuccuggccgucccgcccggcgagcgggcgcgcaacauccagacgcugcccggcaucuucaagaccaaggacggggacaucggcgccguggcccucgacuacccggccgggaccuccggcagccccauccuggacaagugcgggcgcgugaucggccuguacggcaacggggucgugaucaagaacggcuccuacgucagcgccaucacccaggggcggcgcgaggaggagacgcccguggagugcuucgagcccuccaugcucaagaagaagcagcugaccgugcuggaccuccacccgggcgcggggaagacccggcgcguccugcccgagaucgugcgggaggccaucaagacccgccugcggacggugauccucgcccccacccgcgucguggccgccgagauggaggaggcgcugcggggccugcccgugcgcuacaugaccaccgccgucaacgugacgcacagcggcaccgagaucguggaccucaugugccacgccaccuucaccucccggcugcugcagccgauccgcguccccaacuacaaccucuacaucauggacgaggcccacuucacggaccccagcuccaucgccgcgcggggguacaucagcacccgcguggagaugggcgaggccgccgccaucuucaugaccgccaccccgccggggacccgggacgcguuccccgacuccaacagccccaucauggacacggagguggagguccccgagcgcgccugguccagcggcuucgacugggugaccgaccacuccggcaagaccgugugguucgucccgagcgugcggaacgggaacgagaucgccgccugccugaccaaggcgggcaagcgcgugauccagcugagccggaagacguucgagaccgaguuccagaagaccaagcaccaggagugggacuucgucgugaccacggacaucuccgagaugggggccaacuucaaggccgaccgcgugaucgacagccggcgcugccucaagcccgucauccuggacggcgagcgcgugauccuggccgggcccaugcccgugacccacgccuccgcggcccagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgcgagccucuaccgccccgaggccgacaaggucgccgccaucgagggcgaguucaagcugcggaccgagcagcgcaagacguucguggagcugaugaagcggggcgaccucccgguguggcuggccuaccaggucgcguccgccgggaucaccuacaccgaccgccgguggugcuucgacggcaccacgaacaacaccaucauggaggacagcgugcccgccgagguguggacccgccacggggagaagcggguccugaagccccgcuggauggacgcccgggugugcuccgaccacgcggcccucaagagcuucaaggaguucgccgccggcaagcgc

SEQ ID NO: 138 - RNA, 450 nt, Artificial Sequence
  ZIKV (isolate Z1106033) NS4A CDS mRNA GC
ggggccgcguucggcgugauggaggcccugggcacccugcccgggcacaugacggagcgguuccaggaggccaucgacaaccucgccguccugaugcgcgccgagaccggcucccggccguacaaggcggccgccgcccagcugcccgagacccucgagaccaucaugcugcuggggcuccugggcacggugagccugggcaucuucuucgugcucaugcgcaacaaggggaucggcaagaugggguucggcauggucacccugggggccuccgcguggcugauguggcucagcgagaucgagcccgcccgcaucgccugcgugcugaucguggucuuccugcuccugguggugcugauccccgagccggagaagcagcgguccccgcaggacaaccagauggccaucaucaucauggucgcggugggccuccugggccugaucaccgcc

SEQ ID NO: 139 - RNA, 753 nt, Artificial Sequence
  ZIKV (isolate Z1106033) NS4B CDS mRNA GC
aacgagcucggguggcuggagcgcaccaagagcgaccugucccaccucaugggccggcgcgaggagggggccacgaucggcuucagcauggacaucgaccugcggcccgccuccgccugggcgaucuacgccgcccugaccaccuucaucacccccgccgugcagcacgccgucacgaccagcuacaacaacuacucccucauggcgauggccacccaggccggggugcuguucggcaugggcaaggggaugccguucuacgccugggacuucggcgugccccugcucaugaucgggugcuacagccagcugaccccgcugacgcucaucgucgccaucauccugcugguggcgcacuacauguaccucauccccggccugcaggccgccgccgcccgcgcggcccagaagcggaccgccgccgggaucaugaagaacccggucguggacggcaucguggucaccgacaucgacaccaugacgaucgacccccagguggagaagaagaugggccaggugcugcucaucgcggucgccgugagcuccgccauccugagccgcaccgccuggggguggggcgaggccggggcgcugaucaccgccgccaccuccacccucugggagggcagccccaacaaguacuggaacuccagcacggccaccucccugugcaacaucuuccgggggagcuaccuggccggcgcgucccucaucuacaccgugacccgcaacgccggccuggucaagcggcgc

SEQ ID NO: 140 - RNA, 2709 nt, Artificial Sequence
  ZIKV (isolate Z1106033) NS5 CDS mRNA GC
gggggcgggacgggcgagacccugggcgagaaguggaaggcccggcucaaccagaugagcgcccuggaguucuacuccuacaagaagagcgggaucaccgaggugugccgcgaggaggcccggcgcgcgcugaaggacggcguggccaccgggggccacgccgucucccgggggagcgccaagcuccgcuggcugguggagcggggcuaccugcagcccuacggcaaggugaucgaccuggggugcggccgcgggggcugguccuacuacgcggccacgauccggaagguccaggaggugaagggguacaccaagggcggcccggggcacgaggagcccgugcucguccagagcuacggcuggaacaucgugcgccugaaguccgggguggacgucuuccacauggccgccgagcccugcgacacccugcucugcgacaucggcgagagcuccagcagccccgagguggaggaggcccgcacccugcgggugcuguccauggucggggacuggcucgagaagcgcccgggcgcguucugcaucaaggugcugugccccuacacgagcaccaugauggagacccuggagcggcuccagcgccgguacggcgggggccuggugcgcgucccccugucccggaacagcacccacgagauguacuggguguccggggccaagagcaacacgaucaaguccgugagcaccaccucccagcuccugcugggccgcauggacggcccccggcgcccggucaaguacgaggaggacgugaaccucgggagcggcacccgggccguggucuccugcgccgaggcccccaacaugaagaucaucgggaaccgcaucgagcggauccgcagcgagcacgcggagacgugguucuucgacgagaaccaccccuaccggaccugggccuaccacggcuccuacgaggccccgacccaggggagcgccuccagccugaucaacggcguggugcgccugcucuccaagcccugggacgucgugaccggcgugacggggaucgccaugaccgacaccacccccuacggccagcagcgggucuucaaggagaagguggacacgcgcgugcccgacccgcaggaggggacccggcaggucaugagcauggugagcuccuggcuguggaaggagcugggcaagcacaagcgcccccgcgugugcaccaaggaggaguucaucaacaagguccggagcaacgcggcccucggggccaucuucgaggaggagaaggaguggaagaccgccguggaggccgugaacgacccccgcuucugggcgcuggucgacaaggagcgggagcaccaccuccgcggcgagugccaguccugcguguacaacaugaugggcaagcgggagaagaagcagggggaguucggcaaggccaaggggagccgcgccaucugguacauguggcucggcgcccgguuccuggaguucgaggcgcugggguuccucaacgaggaccacuggaugggccgcgagaacuccggcgggggcguggaggggcugggccugcagcggcucggguacguccuggaggagaugagccgcauccccggcggccggauguacgccgacgacacggccgggugggacacccgcaucucccgguucgaccuggagaacgaggcccucaucaccaaccagauggagaagggccaccgcgcccuggcgcuggccaucaucaaguacaccuaccagaacaagguggucaaggugcuccggccggccgagaaggggaagacggugauggacaucaucagccgccaggaccagcggggcuccggccaggucgugaccuacgcccugaacaccuucaccaaccuggugguccagcucauccgcaacauggaggccgaggaggugcuggagaugcaggaccuguggcuccugcggcgcagcgagaaggugaccaacuggcugcaguccaacgggugggaccggcucaagcgcauggcggucagcggcgacgacugcguggugaagcccaucgacgaccgcuucgcccacgcccugcgguuccugaacgacauggggaagguccgcaaggacacgcaggaguggaagcccuccaccggcugggacaacugggaggaggugcccuucugcagccaccacuucaacaagcuccaccugaaggacgggcgguccaucguggucccgugccgccaccaggacgagcugaucggccgggcccgcgugagccccggcgccgggugguccauccgggagaccgcgugccucgccaagagcuacgcccagauguggcagcugcuguacuuccaccgccgggaccuccgccugauggccaacgcgaucugcuccagcgugcccgucgacugggugcccaccggccggacgaccuggagcauccacgggaagggcgaguggaugaccaccgaggacaugcugguggucuggaaccgcguguggaucgaggagaacgaccacauggaggacaagacgccggugaccaaguggaccgacauccccuaccucgggaagcgggaggaccuguggugcggcucccugaucggccaccgcccccggaccacgugggccgagaacaucaagaacaccgucaacauggugcgccggaucaucggggacgaggagaaguacauggacuaccucagcacccaggugcgcuaccugggcgaggagggguccacccccggcguccug

SEQ ID NO: 141 - RNA, 2136 nt, Artificial Sequence
  ZIKV (isolate Z1106033) Polyprotein(93-804) CDS mRNA GC
cggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaag

SEQ ID NO: 142 - RNA, 2136 nt, Artificial Sequence
  ZIKV (isolate Z1106033) Polyprotein(93-804) CDS mRNA GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcaccccgcacuggaacaacaaggaggcgcugguggaguucaaggacgcccacgccaagcggcagaccgucguggugcucgggucccaggagggcgccguccacacggcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgccguucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgugggcggcgcccugaacucccucgggaaggggauccaccagaucuucggcgccgcguucaagagccuguucgggggcauguccugguucagccagauccugaucgggacgcuccugauguggcugggccucaacgccaagaacggguccaucagccugaugugccuggcccucggcggcgugcugaucuuccuguccaccgccgucagcgccgacguggggugcuccguggacuucagcaag

SEQ ID NO: 143 - RNA, 1353 nt, Artificial Sequence
  ZIKV (isolate Z1106033) Polyprotein(273-723) CDS mRNA GC
agccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagc

SEQ ID NO: 144 - RNA, 1353 nt, Artificial Sequence
  ZIKV (isolate Z1106033) Polyprotein(273-723) CDS mRNA GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaacccggugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcucc

SEQ ID NO: 145 - RNA, 10257 nt, Artificial Sequence
  ZIKV (strain MR 766) complete polyprotein CDS mRNA GC
augaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgccggcagcacggaccacauggaccacuucucccugggcgugcuggucauccuccugauggugcaggaggggcugaagaagcggaugaccaccaagaucaucaugagcaccagcauggccgugcucgucgugaugauccugggcggguucuccaugagcgaccuggccaagcucgugauccugaugggcgcgaccuucgccgagaugaacacgggcggcgacgucgcccaccuggcccucguggccgcguucaaggugcgccccgcccugcuggucuccuucaucuuccgggccaacuggaccccgcgcgagagcaugcuccuggcccuggccuccugccuccugcagaccgcgaucagcgcccuggagggggaccucauggugcugaucaacggguucgcccuggccuggcucgcgauccgggccauggccgugccccgcaccgacaacaucgcccugccgauccuggccgcgcucacgccccuggcccggggcacccugcucgucgccuggcgcgccgggcuggccacgugcggcgggaucaugcugcucucccugaagggcaagggcagcgugaagaagaaccugcccuucgugauggcgcucgggcugaccgccguccgggugguggaccccaucaacgucgugggccugcuccugcugacgcgcuccgggaagcggagcuggccgcccuccgaggugcucaccgccgucggccugaucugcgcccuggccgggggcuucgcgaaggccgacaucgagauggccggccccauggccgcgguggggcuccugaucgugagcuacgucguguccggcaagagcguggacauguacaucgagcgcgccggggacaucaccugggagaaggacgccgaggucaccggcaacuccccgcggcuggacguggcccucgacgagagcggggacuucucccugguggaggaggacggcccgcccaugcgcgagaucauccugaaggucgugcucauggccaucugcggcaugaaccccaucgcgaucccguucgccgccggggccugguacguguacgucaagacgggcaagcggagcggggcccugugggacgugcccgcgcccaaggaggugaagaagggcgagaccaccgacggcgucuaccgcgugaugacccggcgccugcugggguccacccaggugggcgucggggugaugcaggagggcguguuccacaccauguggcacgucaccaagggggccgcccuccggagcggcgagggccgccuggaccccuacuggggcgacgugaagcaggaccuggucagcuacugcgggccguggaagcucgacgccgccugggacgggcuguccgaggugcagcugcucgcggugccgcccggcgagcgcgcccggaacauccagacccugcccgggaucuucaagacgaaggacggcgacaucggcgccgucgcccuggacuacccggcggggaccagcggcucccccauccucgacaagugcgggcgcgugaucggccuguacgggaacggcguggucaucaagaacggcagcuacguguccgccaucacccaggggaagcgggaggaggagacccccguggagugcuucgagcccagcaugcugaagaagaagcagcucacgguccuggaccugcacccgggcgccgggaagacccgccgggugcuccccgagaucgugcgcgaggccaucaagaagcggcugcgcaccgucauccuggcccccacccgggugguggcggccgagauggaggaggcccuccgcggccugcccguccgguacaugacgaccgccgugaacgugacccacuccgggaccgagaucgucgaccugaugugccacgccacguucaccagccgccuccugcagccgauccgggugcccaacuacaaccugaacaucauggacgaggcgcacuucaccgaccccuccagcaucgccgcccgcggcuacaucuccacccggguggagaugggcgaggccgccgcgaucuucaugacggccaccccgccggggacccgcgacgccuuccccgacagcaacucccccaucauggacaccgaggucgaggugcccgagcgggccuggagcuccggcuucgacugggugaccgaccacagcgggaagacggucugguucgugccguccgugcgcaacggcaacgagaucgccgcgugccucaccaaggccggcaagcgggucauccagcugagccgcaagaccuucgagaccgaguuccagaagacgaagaaccaggagugggacuucgugaucaccaccgacaucuccgagaugggggccaacuucaaggccgaccgggugaucgacagccgccgcugccugaagcccgucauccucgacggcgagcgggugauccuggcggggcccaugcccgugacccacgccagcgccgcccagcgccggggccgcaucgggcggaacccgaacaagcccggcgacgaguacauguacggcgggggcugcgccgagacggacgaggggcacgcgcacuggcuggaggcccgcaugcuccuggacaacaucuaccugcaggacggccucaucgccucccuguaccggcccgaggccgacaaggucgccgcgaucgagggggaguucaagcugcgcaccgagcagcggaagaccuucguggagcucaugaagcgcggcgaccugccgguguggcuggccuaccaggucgccagcgccggcaucaccuacacggaccggcgcuggugcuucgacgggaccaccaacaacaccaucauggaggacuccgugcccgccgagguguggacgaaguacggcgagaagcggguccucaagccccgcuggauggacgcgcgggugugcagcgaccacgccgcccugaaguccuucaaggaguucgccgcggggaagcgcggcgccgcccugggggugauggaggcccucggcacccugcccggccacaugaccgagcgguuccaggaggccaucgacaaccuggcgguccucaugcgcgccgagaccgggagccggccguacaaggccgccgccgcgcagcugcccgagacgcuggagaccaucaugcuccugggccugcucgggaccgugucccugggcaucuucuucgugcugaugcgcaacaagggcaucgggaagaugggcuucgggauggucacccucggcgccagcgccuggcugauguggcuguccgagaucgagcccgcccgcaucgccugcgugcucaucguggucuuccugcugcucguggugcugauccccgagccggagaagcagcggagcccccaggacaaccagauggcgaucaucaucauggucgccguggggcugcucggccugaucacggccaacgagcugggcuggcucgagcgcaccaagaacgacaucgcccaccugauggggcggcgcgaggagggcgcgaccaugggguucuccauggacaucgaccugcggcccgccagcgccugggccaucuacgccgcgcucaccacgcugaucacccccgccguccagcacgccgugaccaccuccuacaacaacuacagccugauggccauggccacgcaggcgggcgugcucuucgggaugggcaagggcaugccguucaugcacggggaccugggcgucccgcugcucaugauggggugcuacucccagcugaccccgcugacccucaucguggccaucauccugcugguggcccacuacauguaccucauccccggccugcaggccgccgcggcccgcgccgcccagaagcggaccgccgcggggaucaugaagaacccggucguggacggcaucguggucacggacaucgacaccaugaccaucgacccccagguggagaagaagaugggccaggugcugcucaucgccgucgccaucagcuccgccgugcugcugcgcaccgcguggggguggggcgaggccggggcccucaucacggccgccaccagcacccugugggagggcucccccaacaaguacuggaacagcagcaccgcgaccucccugugcaacaucuuccgggggagcuaccucgccggcgccucccugaucuacacggugacccgcaacgccggccuggucaagcggcgcgggggcgggaccggcgagacccucggcgagaaguggaaggcccggcugaaccagaugagcgcgcuggaguucuacuccuacaagaagagcgggaucacggaggugugccgcgaggaggcccggcgcgcccucaaggacggcguggccaccgggggccacgccgucucccgggggagcgcgaagauccgcuggcuggaggagcggggcuaccugcagcccuacggcaaggugguggaccuggggugcggccgcgggggcugguccuacuacgccgccaccauccggaagguccaggaggugcgcggguacaccaagggcggcccggggcacgaggagcccaugcucgugcagagcuacggcuggaacaucguccgccugaaguccgggguggacguguuccacauggccgcggagcccugcgacacgcugcucugcgacaucggcgagagcuccagcucccccgaggucgaggagacccggacccugcgcgugcugagcauggugggggacuggcucgagaagcggccgggcgccuucugcaucaagguccugugccccuacaccuccacgaugauggagaccauggagcgccugcagcggcgccacggcgggggccucgugcgggugccccugugccgcaacagcacccacgagauguacugggucuccggggccaagagcaacaucaucaagagcguguccaccacgagccagcugcuccugggccggauggacggcccccgccggccggugaaguacgaggaggacgucaaccugggguccggcacccgcgccguggccagcugcgcggaggcccccaacaugaagaucaucgggcggcgcaucgagcggauccgcaacgagcacgccgagaccugguuccucgacgagaaccaccccuaccggaccugggccuaccacggcuccuacgaggccccgacgcaggggagcgcguccagccuggugaacggcgucgugcgccugcucuccaagcccugggacguggucaccggcgugaccgggaucgccaugaccgacacgacccccuacggccagcagcggguguucaaggagaaggucgacacccgcgugcccgacccgcaggaggggacccgccaggugaugaacaucgucagcuccuggcuguggaaggagcugggcaagcggaagcgcccccgggugugcacgaaggaggaguucaucaacaaggugcgcagcaacgccgcccucggggccaucuucgaggaggagaaggaguggaagaccgcggucgaggccgugaacgacccccgguucugggcccuggucgaccgcgagcgggagcaccaccuccgcggcgagugccacuccugcguguacaacaugaugggcaagcgggagaagaagcagggggaguucggcaaggccaaggggagccgcgccaucugguacauguggcucggcgcgcgguuccuggaguucgaggcccugggguuccucaacgaggaccacuggaugggccgcgagaacuccggcgggggcguggaggggcugggccugcagcggcucggguacauccuggaggagaugaaccgcgcccccggcggcaagauguacgccgacgacaccgcggggugggacacccggaucagcaaguucgaccuggagaacgaggcccucaucacgaaccagauggaggagggccaccgcacccuggcccuggccgucaucaaguacaccuaccagaacaagguggugaagguccuccggccggccgagggcgggaagaccgugauggacaucaucucccgccaggaccagcggggcagcggccagguggucacguacgcgcugaacaccuucaccaaccugguggugcagcucauccgcaacauggaggccgaggagguccuggagaugcaggaccuguggcuccugcggaagcccgagaaggugacccgcuggcugcagagcaacggcugggaccgccucaagcggauggccguguccggggacgacugcgucgugaagcccaucgacgaccgcuucgcccacgcccugcgguuccugaacgacaugggcaaggugcgcaaggacacccaggaguggaagcccagcacggggugguccaacugggaggaggucccguucugcagccaccacuucaacaagcucuaccugaaggacggccgguccaucguggugcccugccgccaccaggacgagcugaucggccgggcgcgcgucagccccggggccggcugguccauccgggagaccgccugccucgccaagagcuacgcccagauguggcagcugcuguacuuccaccgccgggaccuccgccugauggcgaacgccaucugcuccgccgugcccguggacugggucccgaccgggcggaccacguggagcauccacggcaagggggaguggaugaccaccgaggacaugcugaugguguggaaccgcguguggaucgaggagaacgaccacauggaggacaagacccccgucacgaaguggaccgacauccccuaccucggcaagcgggaggaccuguggugcggcucccugaucgggcaccgcccccggaccaccugggccgagaacaucaaggacacggugaacauggugcgccggaucaucggcgacgaggagaaguacauggacuaccucagcacccagguccgcuaccugggggaggagggcuccaccccgggggugcug

SEQ ID NO: 146 - RNA, 312 nt, Artificial Sequence
  ZIKV (strain MR 766) C CDS mRNA GC
augaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccgg

SEQ ID NO: 147 - RNA, 366 nt, Artificial Sequence
  ZIKV (strain MR 766) C-ER anchor CDS mRNA GC
augaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcg

SEQ ID NO: 148 - RNA, 279 nt, Artificial Sequence
  ZIKV (strain MR 766) pr CDS mRNA GC
gccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgc

SEQ ID NO: 149 - RNA, 225 nt, Artificial Sequence
  ZIKV (strain MR 766) M CDS mRNA GC
gccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagc

SEQ ID NO: 150 - RNA, 504 nt, Artificial Sequence
  ZIKV (strain MR 766) prM CDS mRNA GC
gccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagc

SEQ ID NO: 151 - RNA, 1500 nt, Artificial Sequence
  ZIKV (strain MR 766) E CDS mRNA GC
auccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 152 - RNA, 2004 nt, Artificial Sequence
  ZIKV (strain MR 766) prME CDS mRNA GC
gccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 153 - RNA, 1056 nt, Artificial Sequence
  ZIKV (strain MR 766) NS1 CDS mRNA GC
gacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgcc

SEQ ID NO: 154 - RNA, 675 nt, Artificial Sequence
  ZIKV (strain MR 766) NS2A CDS mRNA GC
ggcagcacggaccacauggaccacuucucccugggcgugcuggucauccuccugauggugcaggaggggcugaagaagcggaugaccaccaagaucaucaugagcaccagcauggccgugcucgucgugaugauccugggcggguucuccaugagcgaccuggccaagcucgugauccugaugggcgcgaccuucgccgagaugaacacgggcggcgacgucgcccaccuggcccucguggccgcguucaaggugcgccccgcccugcuggucuccuucaucuuccgggccaacuggaccccgcgcgagagcaugcuccuggcccuggccuccugccuccugcagaccgcgaucagcgcccuggagggggaccucauggugcugaucaacggguucgcccuggccuggcucgcgauccgggccauggccgugccccgcaccgacaacaucgcccugccgauccuggccgcgcucacgccccuggcccggggcacccugcucgucgccuggcgcgccgggcuggccacgugcggcgggaucaugcugcucucccugaagggcaagggcagcgugaagaagaaccugcccuucgugauggcgcucgggcugaccgccguccgggugguggaccccaucaacgucgugggccugcuccugcugacgcgcuccgggaag

SEQ ID NO: 155 - RNA, 390 nt, Artificial Sequence
  ZIKV (strain MR 766) NS2B CDS mRNA GC
agcuggccgcccuccgaggugcucaccgccgucggccugaucugcgcccuggccgggggcuucgcgaaggccgacaucgagauggccggccccauggccgcgguggggcuccugaucgugagcuacgucguguccggcaagagcguggacauguacaucgagcgcgccggggacaucaccugggagaaggacgccgaggucaccggcaacuccccgcggcuggacguggcccucgacgagagcggggacuucucccugguggaggaggacggcccgcccaugcgcgagaucauccugaaggucgugcucauggccaucugcggcaugaaccccaucgcgaucccguucgccgccggggccugguacguguacgucaagacgggcaagcgg

SEQ ID NO: 156 - RNA, 1851 nt, Artificial Sequence
  ZIKV (strain MR 766) NS3 CDS mRNA GC
agcggggcccugugggacgugcccgcgcccaaggaggugaagaagggcgagaccaccgacggcgucuaccgcgugaugacccggcgccugcugggguccacccaggugggcgucggggugaugcaggagggcguguuccacaccauguggcacgucaccaagggggccgcccuccggagcggcgagggccgccuggaccccuacuggggcgacgugaagcaggaccuggucagcuacugcgggccguggaagcucgacgccgccugggacgggcuguccgaggugcagcugcucgcggugccgcccggcgagcgcgcccggaacauccagacccugcccgggaucuucaagacgaaggacggcgacaucggcgccgucgcccuggacuacccggcggggaccagcggcucccccauccucgacaagugcgggcgcgugaucggccuguacgggaacggcguggucaucaagaacggcagcuacguguccgccaucacccaggggaagcgggaggaggagacccccguggagugcuucgagcccagcaugcugaagaagaagcagcucacgguccuggaccugcacccgggcgccgggaagacccgccgggugcuccccgagaucgugcgcgaggccaucaagaagcggcugcgcaccgucauccuggcccccacccgggugguggcggccgagauggaggaggcccuccgcggccugcccguccgguacaugacgaccgccgugaacgugacccacuccgggaccgagaucgucgaccugaugugccacgccacguucaccagccgccuccugcagccgauccgggugcccaacuacaaccugaacaucauggacgaggcgcacuucaccgaccccuccagcaucgccgcccgcggcuacaucuccacccggguggagaugggcgaggccgccgcgaucuucaugacggccaccccgccggggacccgcgacgccuuccccgacagcaacucccccaucauggacaccgaggucgaggugcccgagcgggccuggagcuccggcuucgacugggugaccgaccacagcgggaagacggucugguucgugccguccgugcgcaacggcaacgagaucgccgcgugccucaccaaggccggcaagcgggucauccagcugagccgcaagaccuucgagaccgaguuccagaagacgaagaaccaggagugggacuucgugaucaccaccgacaucuccgagaugggggccaacuucaaggccgaccgggugaucgacagccgccgcugccugaagcccgucauccucgacggcgagcgggugauccuggcggggcccaugcccgugacccacgccagcgccgcccagcgccggggccgcaucgggcggaacccgaacaagcccggcgacgaguacauguacggcgggggcugcgccgagacggacgaggggcacgcgcacuggcuggaggcccgcaugcuccuggacaacaucuaccugcaggacggccucaucgccucccuguaccggcccgaggccgacaaggucgccgcgaucgagggggaguucaagcugcgcaccgagcagcggaagaccuucguggagcucaugaagcgcggcgaccugccgguguggcuggccuaccaggucgccagcgccggcaucaccuacacggaccggcgcuggugcuucgacgggaccaccaacaacaccaucauggaggacuccgugcccgccgagguguggacgaaguacggcgagaagcggguccucaagccccgcuggauggacgcgcgggugugcagcgaccacgccgcccugaaguccuucaaggaguucgccgcggggaagcgc

SEQ ID NO: 157 - RNA, 450 nt, Artificial Sequence
  ZIKV (strain MR 766) NS4A CDS mRNA GC
ggcgccgcccugggggugauggaggcccucggcacccugcccggccacaugaccgagcgguuccaggaggccaucgacaaccuggcgguccucaugcgcgccgagaccgggagccggccguacaaggccgccgccgcgcagcugcccgagacgcuggagaccaucaugcuccugggccugcucgggaccgugucccugggcaucuucuucgugcugaugcgcaacaagggcaucgggaagaugggcuucgggauggucacccucggcgccagcgccuggcugauguggcuguccgagaucgagcccgcccgcaucgccugcgugcucaucguggucuuccugcugcucguggugcugauccccgagccggagaagcagcggagcccccaggacaaccagauggcgaucaucaucauggucgccguggggcugcucggccugaucacggcc

SEQ ID NO: 158 - RNA, 753 nt, Artificial Sequence
  ZIKV (strain MR 766) NS4B CDS mRNA GC
aacgagcugggcuggcucgagcgcaccaagaacgacaucgcccaccugauggggcggcgcgaggagggcgcgaccaugggguucuccauggacaucgaccugcggcccgccagcgccugggccaucuacgccgcgcucaccacgcugaucacccccgccguccagcacgccgugaccaccuccuacaacaacuacagccugauggccauggccacgcaggcgggcgugcucuucgggaugggcaagggcaugccguucaugcacggggaccugggcgucccgcugcucaugauggggugcuacucccagcugaccccgcugacccucaucguggccaucauccugcugguggcccacuacauguaccucauccccggccugcaggccgccgcggcccgcgccgcccagaagcggaccgccgcggggaucaugaagaacccggucguggacggcaucguggucacggacaucgacaccaugaccaucgacccccagguggagaagaagaugggccaggugcugcucaucgccgucgccaucagcuccgccgugcugcugcgcaccgcguggggguggggcgaggccggggcccucaucacggccgccaccagcacccugugggagggcucccccaacaaguacuggaacagcagcaccgcgaccucccugugcaacaucuuccgggggagcuaccucgccggcgccucccugaucuacacggugacccgcaacgccggccuggucaagcggcgc

SEQ ID NO: 159 - RNA, 2709 nt, Artificial Sequence
  ZIKV (strain MR 766) NS5 CDS mRNA GC
gggggcgggaccggcgagacccucggcgagaaguggaaggcccggcugaaccagaugagcgcgcuggaguucuacuccuacaagaagagcgggaucacggaggugugccgcgaggaggcccggcgcgcccucaaggacggcguggccaccgggggccacgccgucucccgggggagcgcgaagauccgcuggcuggaggagcggggcuaccugcagcccuacggcaaggugguggaccuggggugcggccgcgggggcugguccuacuacgccgccaccauccggaagguccaggaggugcgcggguacaccaagggcggcccggggcacgaggagcccaugcucgugcagagcuacggcuggaacaucguccgccugaaguccgggguggacguguuccacauggccgcggagcccugcgacacgcugcucugcgacaucggcgagagcuccagcucccccgaggucgaggagacccggacccugcgcgugcugagcauggugggggacuggcucgagaagcggccgggcgccuucugcaucaagguccugugccccuacaccuccacgaugauggagaccauggagcgccugcagcggcgccacggcgggggccucgugcgggugccccugugccgcaacagcacccacgagauguacugggucuccggggccaagagcaacaucaucaagagcguguccaccacgagccagcugcuccugggccggauggacggcccccgccggccggugaaguacgaggaggacgucaaccugggguccggcacccgcgccguggccagcugcgcggaggcccccaacaugaagaucaucgggcggcgcaucgagcggauccgcaacgagcacgccgagaccugguuccucgacgagaaccaccccuaccggaccugggccuaccacggcuccuacgaggccccgacgcaggggagcgcguccagccuggugaacggcgucgugcgccugcucuccaagcccugggacguggucaccggcgugaccgggaucgccaugaccgacacgacccccuacggccagcagcggguguucaaggagaaggucgacacccgcgugcccgacccgcaggaggggacccgccaggugaugaacaucgucagcuccuggcuguggaaggagcugggcaagcggaagcgcccccgggugugcacgaaggaggaguucaucaacaaggugcgcagcaacgccgcccucggggccaucuucgaggaggagaaggaguggaagaccgcggucgaggccgugaacgacccccgguucugggcccuggucgaccgcgagcgggagcaccaccuccgcggcgagugccacuccugcguguacaacaugaugggcaagcgggagaagaagcagggggaguucggcaaggccaaggggagccgcgccaucugguacauguggcucggcgcgcgguuccuggaguucgaggcccugggguuccucaacgaggaccacuggaugggccgcgagaacuccggcgggggcguggaggggcugggccugcagcggcucggguacauccuggaggagaugaaccgcgcccccggcggcaagauguacgccgacgacaccgcggggugggacacccggaucagcaaguucgaccuggagaacgaggcccucaucacgaaccagauggaggagggccaccgcacccuggcccuggccgucaucaaguacaccuaccagaacaagguggugaagguccuccggccggccgagggcgggaagaccgugauggacaucaucucccgccaggaccagcggggcagcggccagguggucacguacgcgcugaacaccuucaccaaccugguggugcagcucauccgcaacauggaggccgaggagguccuggagaugcaggaccuguggcuccugcggaagcccgagaaggugacccgcuggcugcagagcaacggcugggaccgccucaagcggauggccguguccggggacgacugcgucgugaagcccaucgacgaccgcuucgcccacgcccugcgguuccugaacgacaugggcaaggugcgcaaggacacccaggaguggaagcccagcacggggugguccaacugggaggaggucccguucugcagccaccacuucaacaagcucuaccugaaggacggccgguccaucguggugcccugccgccaccaggacgagcugaucggccgggcgcgcgucagccccggggccggcugguccauccgggagaccgccugccucgccaagagcuacgcccagauguggcagcugcuguacuuccaccgccgggaccuccgccugauggcgaacgccaucugcuccgccgugcccguggacugggucccgaccgggcggaccacguggagcauccacggcaagggggaguggaugaccaccgaggacaugcugaugguguggaaccgcguguggaucgaggagaacgaccacauggaggacaagacccccgucacgaaguggaccgacauccccuaccucggcaagcgggaggaccuguggugcggcucccugaucgggcaccgcccccggaccaccugggccgagaacaucaaggacacggugaacauggugcgccggaucaucggcgacgaggagaaguacauggacuaccucagcacccagguccgcuaccugggggaggagggcuccaccccgggggugcug

SEQ ID NO: 160 - RNA, 2124 nt, Artificial Sequence
  ZIKV (strain MR 766) Polyprotein(93-800) CDS mRNA GC
cggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaag

SEQ ID NO: 161 - RNA, 2124 nt, Artificial Sequence
  ZIKV (strain MR 766) Polyprotein(93-800) CDS mRNA GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucaccugcagcaagaagaugaccggcaaguccauccagcccgagaaccuggaguaccgcaucaugcugagcgugcacggcucccagcacagcgggaugaucggcuacgagaccgacgaggaccgcgccaaggucgaggugacgcccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggccgccucuucuccgggcaccugaagugccggcugaagauggacaagcuccgccugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcggcugaucacggccaacccggugaucaccgagagcaccgagaacuccaagaugaugcucgagcuggacccgcccuucggcgacagcuacaucgugaucggggucggcgacaagaagaucacccaccacuggcaccgcuccgggagcacgaucggcaaggccuucgaggcgaccgugcggggcgccaagcgcauggccgugcugggggacaccgccugggacuucggcagcgucgggggcguguucaacucccuggggaagggcauccaccagaucuucggcgccgcguucaagagccucuucgggggcauguccugguucagccagauccugaucgggacccugcucguguggcugggccugaacacgaagaacggguccaucagccucaccugccuggcccugggcggcgucaugaucuuccucuccaccgccgugagcgccgacguggggugcuccgucgacuucagcaag

SEQ ID NO: 162 - RNA, 1341 nt, Artificial Sequence
  ZIKV (strain MR 766) Polyprotein(273-719) CDS mRNA GC
ucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagc

SEQ ID NO: 163 - RNA, 1341 nt, Artificial Sequence
  ZIKV (strain MR 766) Polyprotein(273-719) CDS mRNA GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgaggaccgggccaagguggaggugacccccaacuccccgcgcgccgaggccacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcuguucagcgggcaccugaagugccgccucaagauggacaagcugcggcugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcgccucaucacggccaacccggucaucaccgaguccaccgagaacagcaagaugaugcuggagcuggacccgcccuucggcgacuccuacaucgugaucggggugggcgacaagaagaucacccaccacuggcaccggagcggguccacgaucggcaaggccuucgaggccaccguccgcggcgccaagcggauggcggugcucggggacaccgccugggacuucggcagc

SEQ ID NO: 164 - RNA, 2136 nt, Artificial Sequence
  ZIKV (strain ZikaSPH2015) Polyprotein(93-804) CDS mRNA optimized
cggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacaccaagaacggcagcaucucccugaugugccuggcucugggaggcgugcugaucuuccugagcacagccgugucugccgacgugggcugcagcguggacuucagcaaa

SEQ ID NO: 165 - RNA, 1353 nt, Artificial Sequence
  ZIKV (strain ZikaSPH2015) Polyprotein(273-723)  CDS mRNA optimized
ucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucu

SEQ ID NO: 166 - RNA, 2136 nt, Artificial Sequence
  ZIKV (isolate Z1106033) Polyprotein(93-804) CDS mRNA optimized
cggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaccugugacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacgccaagaacggcagcaucucccugaugugccuggcucugggaggcgugcugaucuuccugagcacagccgugucugccgacgugggcugcagcguggacuucagcaaa

SEQ ID NO: 167 - RNA, 1353 nt, Artificial Sequence
  ZIKV (isolate Z1106033) Polyprotein(273-723)  CDS mRNA optimized
ucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucu

SEQ ID NO: 168 - RNA, 2124 nt, Artificial Sequence
  ZIKV (strain MR 766) Polyprotein(93-800) CDS mRNA optimized
cggaucaucaacgcccggaaagagcggaagcggagaggcgccgauaccagcaucggcaucaucggccugcugcugaccacagccauggccgccgagaucaccagaagaggcagcgccuacuacauguaccuggacagaagcgacgccggcaaggccaucagcuuugccacaacccugggcgugaacaagugccacgugcagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaggccagacggucuagaagggccgugacacugccuagccacagcacccggaagcugcagaccagaagccagaccuggcuggaaagcagagaguacaccaagcaccugaucaagguggaaaacuggaucuuccggaaccccggcuucgcccugguggccguggcuauugcuuggcugcugggcagcuccaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucugugggcggcguguucaacucccugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggcggagugaugaucuuccugagcaccgccguguccgccgaugugggcuguagcguggacuucagcaaa

SEQ ID NO: 169 - RNA, 1341 nt, Artificial Sequence
  ZIKV (strain MR 766) Polyprotein(273-719)  CDS mRNA optimized
ucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucu

SEQ ID NO: 170 - RNA, 2136 nt, Artificial Sequence
  ZIKV (strain ZikaSPH2015) Polyprotein(93-804) CDS mRNA optimized
cggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacaccaagaacggcagcauuagccugaugugccuggcccugggcggcgugcugaucuuccugagcaccgccguguccgccgacgugggcugcagcguggacuucuccaaa

SEQ ID NO: 171 - RNA, 1353 nt, Artificial Sequence
  ZIKV (strain ZikaSPH2015) Polyprotein(273-723)  CDS mRNA optimized
agccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucu

SEQ ID NO: 172 - RNA, 2136 nt, Artificial Sequence
  ZIKV (isolate Z1106033) Polyprotein(93-804) CDS mRNA optimized
cggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaccugugacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccguguccgccgacgugggcugcagcguggacuucuccaaa

SEQ ID NO: 173 - RNA, 1353 nt, Artificial Sequence
  ZIKV (isolate Z1106033) Polyprotein(273-723)  CDS mRNA optimized
agccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucu

SEQ ID NO: 174 - RNA, 2124 nt, Artificial Sequence
  ZIKV (strain MR 766) Polyprotein(93-800) CDS mRNA optimized
cggaucaucaacgcccggaaagagcggaagcggagaggcgccgacaccagcaucggcaucaucggccugcugcugaccaccgccauggccgccgagaucaccagacggggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugaucaagguggaaaacuggaucuuccggaaccccggcuucgcccugguggccguggcuauugccuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcuccgugggcggcguguucaacagccugggcaagggcauccaccagaucuucggagccgccuucaagagccuguucggcggcaugagcugguucagccagauccugaucggcacccugcuggucuggcugggccugaacaccaagaacggcagcaucagccugaccugccuggcccugggcggagugaugaucuuccugagcaccgccgugucugccgacgugggcugcagcguggacuucuccaaa

SEQ ID NO: 175 - RNA, 1341 nt, Artificial Sequence
  ZIKV (strain MR 766) Polyprotein(273-719)  CDS mRNA optimized
agccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcucc

SEQ ID NO: 176 - RNA, 10269 nt, Artificial Sequence
  ZIKV (strain ZikaSPH2015) complete polyprotein CDS mRNA optimized
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgacuacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaugggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugauggccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcug

SEQ ID NO: 177 - RNA, 312 nt, Artificial Sequence
  ZIKV (strain ZikaSPH2015) C CDS mRNA optimized
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgc

SEQ ID NO: 178 - RNA, 366 nt, Artificial Sequence
  ZIKV (strain ZikaSPH2015) C-ER anchor CDS mRNA optimized
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggcc

SEQ ID NO: 179 - RNA, 279 nt, Artificial Sequence
  ZIKV (strain ZikaSPH2015) pr CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgc

SEQ ID NO: 180 - RNA, 225 nt, Artificial Sequence
  ZIKV (strain ZikaSPH2015) M CDS mRNA optimized
gccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagc

SEQ ID NO: 181 - RNA, 504 nt, Artificial Sequence
  ZIKV (strain ZikaSPH2015) prM CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagc

SEQ ID NO: 182 - RNA, 1512 nt, Artificial Sequence
  ZIKV (strain ZikaSPH2015) E CDS mRNA optimized
auccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 183 - RNA, 2016 nt, Artificial Sequence
  ZIKV (strain ZikaSPH2015) prME CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 184 - RNA, 1056 nt, Artificial Sequence
  ZIKV (strain ZikaSPH2015) NS1 CDS mRNA optimized
gacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 185 - RNA, 678 nt, Artificial Sequence
  ZIKV (strain ZikaSPH2015) NS2A CDS mRNA optimized
ggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgc

SEQ ID NO: 186 - RNA, 390 nt, Artificial Sequence
  ZIKV (strain ZikaSPH2015) NS2B CDS mRNA optimized
agcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgc

SEQ ID NO: 187 - RNA, 1851 nt, Artificial Sequence
  ZIKV (strain ZikaSPH2015) NS3 CDS mRNA optimized
agcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgacuacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgc

SEQ ID NO: 188 - RNA, 450 nt, Artificial Sequence
  ZIKV (strain ZikaSPH2015) NS4A CDS mRNA optimized
ggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgcc

SEQ ID NO: 189 - RNA, 753 nt, Artificial Sequence
  ZIKV (strain ZikaSPH2015) NS4B CDS mRNA optimized
aacgagcugggcuggcuggagcgcaccaagagcgaccugagccaccugaugggccgccgcgaggagggcgccaccaugggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugauggccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgc

SEQ ID NO: 190 - RNA, 2709 nt, Artificial Sequence
  ZIKV (strain ZikaSPH2015) NS5 CDS mRNA optimized
ggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcug

SEQ ID NO: 191 - RNA, 2136 nt, Artificial Sequence
  ZIKV (strain ZikaSPH2015) Polyprotein(93-804) CDS mRNA optimized
cgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 192 - RNA, 2136 nt, Artificial Sequence; identical to SEQ ID NO: 191
  ZIKV (strain ZikaSPH2015) Polyprotein(93-804) CDS mRNA optimized

SEQ ID NO: 193 - RNA, 1353 nt, Artificial Sequence
  ZIKV (strain ZikaSPH2015) Polyprotein(273-723) CDS mRNA optimized
agccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagc

SEQ ID NO: 194 - RNA, 1353 nt, Artificial Sequence; identical to SEQ ID NO: 193
  ZIKV (strain ZikaSPH2015) Polyprotein(273-723) CDS mRNA optimized

SEQ ID NO: 195 - RNA, 10269 nt, Artificial Sequence
  ZIKV (isolate Z1106033) complete polyprotein CDS mRNA optimized
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaucggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcug

SEQ ID NO: 196 - RNA, 312 nt, Artificial Sequence; identical to SEQ ID NO: 177
  ZIKV (isolate Z1106033) C CDS mRNA optimized

SEQ ID NO: 197 - RNA, 366 nt, Artificial Sequence; identical to SEQ ID NO: 178
  ZIKV (isolate Z1106033) C-ER anchor CDS mRNA optimized

SEQ ID NO: 198 - RNA, 279 nt, Artificial Sequence
  ZIKV (isolate Z1106033) pr CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgc

SEQ ID NO: 199 - RNA, 225 nt, Artificial Sequence; identical to SEQ ID NO: 180
  ZIKV (isolate Z1106033) M CDS mRNA optimized

SEQ ID NO: 200 - RNA, 504 nt, Artificial Sequence
  ZIKV (isolate Z1106033) prM CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagc

SEQ ID NO: 201 - RNA, 1512 nt, Artificial Sequence
  ZIKV (isolate Z1106033) E CDS mRNA optimized
auccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 202 - RNA, 2016 nt, Artificial Sequence
  ZIKV (isolate Z1106033) prME CDS mRNA optimized
gccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 203 - RNA, 1056 nt, Artificial Sequence
  ZIKV (isolate Z1106033) NS1 CDS mRNA optimized
gacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 204 - RNA, 678 nt, Artificial Sequence; identical to SEQ ID NO: 185
  ZIKV (isolate Z1106033) NS2A CDS mRNA optimized

SEQ ID NO: 205 - RNA, 390 nt, Artificial Sequence; identical to SEQ ID NO: 186
  ZIKV (isolate Z1106033) NS2B CDS mRNA optimized

SEQ ID NO: 206 - RNA, 1851 nt, Artificial Sequence
  ZIKV (isolate Z1106033) NS3 CDS mRNA optimized
agcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgc

SEQ ID NO: 207 - RNA, 450 nt, Artificial Sequence; identical to SEQ ID NO: 188
  ZIKV (isolate Z1106033) NS4A CDS mRNA optimized

SEQ ID NO: 208 - RNA, 753 nt, Artificial Sequence
  ZIKV (isolate Z1106033) NS4B CDS mRNA optimized
aacgagcugggcuggcuggagcgcaccaagagcgaccugagccaccugaugggccgccgcgaggagggcgccaccaucggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgc

SEQ ID NO: 209 - RNA, 2709 nt, Artificial Sequence; identical to SEQ ID NO: 190
  ZIKV (isolate Z1106033) NS5 CDS mRNA optimized

SEQ ID NO: 210 - RNA, 2136 nt, Artificial Sequence
  ZIKV (isolate Z1106033) Polyprotein(93-804) CDS mRNA optimized
cgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaag

SEQ ID NO: 211 - RNA, 2136 nt, Artificial Sequence; identical to SEQ ID NO: 210
  ZIKV (isolate Z1106033) Polyprotein(93-804) CDS mRNA optimized

SEQ ID NO: 212 - RNA, 1353 nt, Artificial Sequence
  ZIKV (isolate Z1106033) Polyprotein(273-723) CDS mRNA optimized
agccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagc

SEQ ID NO: 213 - RNA, 1353 nt, Artificial Sequence; identical to SEQ ID NO: 212
  ZIKV (isolate Z1106033) Polyprotein273-719) CDS mRNA optimized

SEQ ID NO: 214 - RNA, 10257 nt, Artificial Sequence
  ZIKV (strain MR 766) complete polyprotein CDS mRNA optimized
augaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaugagcaccagcauggccgugcugguggugaugauccugggcggcuucagcaugagcgaccuggccaagcuggugauccugaugggcgccaccuucgccgagaugaacaccggcggcgacguggcccaccuggcccugguggccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccauggccgugccccgcaccgacaacaucgcccugcccauccuggccgcccugaccccccuggcccgcggcacccugcugguggccuggcgcgccggccuggccaccugcggcggcaucaugcugcugagccugaagggcaagggcagcgugaagaagaaccugcccuucgugauggcccugggccugaccgccgugcgcgugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggaggacggcccccccaugcgcgagaucauccugaagguggugcugauggccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcgccgcccugcgcagcggcgagggccgccuggaccccuacuggggcgacgugaagcaggaccuggugagcuacugcggccccuggaagcuggacgccgccugggacggccugagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggcaagcgcgaggaggagacccccguggagugcuucgagcccagcaugcugaagaagaagcagcugaccgugcuggaccugcaccccggcgccggcaagacccgccgcgugcugcccgagaucgugcgcgaggccaucaagaagcgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccugaacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagaaccaggagugggacuucgugaucaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguacauguacggcggcggcugcgccgagaccgacgagggccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggaccaaguacggcgagaagcgcgugcugaagccccgcuggauggacgcccgcgugugcagcgaccacgccgcccugaagagcuucaaggaguucgccgccggcaagcgcggcgccgcccugggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagaacgacaucgcccaccugaugggccgccgcgaggagggcgccaccaugggcuucagcauggacaucgaccugcgccccgccagcgccugggccaucuacgccgcccugaccacccugaucacccccgccgugcagcacgccgugaccaccagcuacaacaacuacagccugauggccauggccacccaggccggcgugcuguucggcaugggcaagggcaugcccuucaugcacggcgaccugggcgugccccugcugaugaugggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccaucagcagcgccgugcugcugcgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagauccgcuggcuggaggagcgcggcuaccugcagcccuacggcaaggugguggaccugggcugcggccgcggcggcuggagcuacuacgccgccaccauccgcaaggugcaggaggugcgcggcuacaccaagggcggccccggccacgaggagcccaugcuggugcagagcuacggcuggaacaucgugcgccugaagagcggcguggacguguuccacauggccgccgagcccugcgacacccugcugugcgacaucggcgagagcagcagcagccccgagguggaggagacccgcacccugcgcgugcugagcauggugggcgacuggcuggagaagcgccccggcgccuucugcaucaaggugcugugccccuacaccagcaccaugauggagaccauggagcgccugcagcgccgccacggcggcggccuggugcgcgugccccugugccgcaacagcacccacgagauguacugggugagcggcgccaagagcaacaucaucaagagcgugagcaccaccagccagcugcugcugggccgcauggacggcccccgccgccccgugaaguacgaggaggacgugaaccugggcagcggcacccgcgccguggccagcugcgccgaggcccccaacaugaagaucaucggccgccgcaucgagcgcauccgcaacgagcacgccgagaccugguuccuggacgagaaccaccccuaccgcaccugggccuaccacggcagcuacgaggcccccacccagggcagcgccagcagccuggugaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugaacaucgugagcagcuggcuguggaaggagcugggcaagcgcaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggaccgcgagcgcgagcaccaccugcgcggcgagugccacagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacauccuggaggagaugaaccgcgcccccggcggcaagauguacgccgacgacaccgccggcugggacacccgcaucagcaaguucgaccuggagaacgaggcccugaucaccaaccagauggaggagggccaccgcacccuggcccuggccgugaucaaguacaccuaccagaacaagguggugaaggugcugcgccccgccgagggcggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgcaagcccgagaaggugacccgcuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcuggagcaacugggaggaggugcccuucugcagccaccacuucaacaagcuguaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcgccgugcccguggacugggugcccaccggccgcaccaccuggagcauccacggcaagggcgaguggaugaccaccgaggacaugcugaugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaaggacaccgugaacauggugcgccgcaucaucggcgacgaggagaaguacauggacuaccugagcacccaggugcgcuaccugggcgaggagggcagcacccccggcgugcug

SEQ ID NO: 215 - RNA, 312 nt, Artificial Sequence
  ZIKV (strain MR 766) C CDS mRNA optimized
augaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgc

SEQ ID NO: 216 - RNA, 366 nt, Artificial Sequence
  ZIKV (strain MR 766) C-ER anchor CDS mRNA optimized
augaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggcc

SEQ ID NO: 217 - RNA, 279 nt, Artificial Sequence
  ZIKV (strain MR 766) pr CDS mRNA optimized
gccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgc

SEQ ID NO: 218 - RNA, 225 nt, Artificial Sequence
  ZIKV (strain MR 766) M CDS mRNA optimized
gccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagc

SEQ ID NO: 219 - RNA, 504 nt, Artificial Sequence
  ZIKV (strain MR 766) prM CDS mRNA optimized
gccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagc

SEQ ID NO: 220 - RNA, 1500 nt, Artificial Sequence
  ZIKV (strain MR 766) E CDS mRNA optimized
auccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 221 - RNA, 2004 nt, Artificial Sequence
  ZIKV (strain MR 766) prME CDS mRNA optimized
gccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 222 - RNA, 1056 nt, Artificial Sequence
  ZIKV (strain MR 766) NS1 CDS mRNA optimized
gacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 223 - RNA, 678 nt, Artificial Sequence
  ZIKV (strain MR 766) NS2A CDS mRNA optimized
ggcagcaccgaccacauggaccacuucagccugggcgugcuggugauccugcugauggugcaggagggccugaagaagcgcaugaccaccaagaucaucaugagcaccagcauggccgugcugguggugaugauccugggcggcuucagcaugagcgaccuggccaagcuggugauccugaugggcgccaccuucgccgagaugaacaccggcggcgacguggcccaccuggcccugguggccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccauggccgugccccgcaccgacaacaucgcccugcccauccuggccgcccugaccccccuggcccgcggcacccugcugguggccuggcgcgccggccuggccaccugcggcggcaucaugcugcugagccugaagggcaagggcagcgugaagaagaaccugcccuucgugauggcccugggccugaccgccgugcgcgugguggaccccaucaacguggugggccugcugcugcugacccgcagcggcaagcgc

SEQ ID NO: 224 - RNA, 390 nt, Artificial Sequence
  ZIKV (strain MR 766) NS2B CDS mRNA optimized
agcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggaggacggcccccccaugcgcgagaucauccugaagguggugcugauggccaucugcggcaugaaccccaucgccauccccuucgccgccggcgccugguacguguacgugaagaccggcaagcgc

SEQ ID NO: 225 - RNA, 1851 nt, Artificial Sequence
  ZIKV (strain MR 766) NS3 CDS mRNA optimized
agcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcgccgcccugcgcagcggcgagggccgccuggaccccuacuggggcgacgugaagcaggaccuggugagcuacugcggccccuggaagcuggacgccgccugggacggccugagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggcaagcgcgaggaggagacccccguggagugcuucgagcccagcaugcugaagaagaagcagcugaccgugcuggaccugcaccccggcgccggcaagacccgccgcgugcugcccgagaucgugcgcgaggccaucaagaagcgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccugaacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagaaccaggagugggacuucgugaucaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguacauguacggcggcggcugcgccgagaccgacgagggccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggaccaaguacggcgagaagcgcgugcugaagccccgcuggauggacgcccgcgugugcagcgaccacgccgcccugaagagcuucaaggaguucgccgccggcaagcgc

SEQ ID NO: 226 - RNA, 450 nt, Artificial Sequence
  ZIKV (strain MR 766) NS4A CDS mRNA optimized
ggcgccgcccugggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgcc

SEQ ID NO: 227 - RNA, 753 nt, Artificial Sequence
  ZIKV (strain MR 766) NS4B CDS mRNA optimized
aacgagcugggcuggcuggagcgcaccaagaacgacaucgcccaccugaugggccgccgcgaggagggcgccaccaugggcuucagcauggacaucgaccugcgccccgccagcgccugggccaucuacgccgcccugaccacccugaucacccccgccgugcagcacgccgugaccaccagcuacaacaacuacagccugauggccauggccacccaggccggcgugcuguucggcaugggcaagggcaugcccuucaugcacggcgaccugggcgugccccugcugaugaugggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccaucagcagcgccgugcugcugcgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgc

SEQ ID NO: 228 - RNA, 2709 nt, Artificial Sequence
  ZIKV (strain MR 766) NS5 CDS mRNA optimized
ggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagauccgcuggcuggaggagcgcggcuaccugcagcccuacggcaaggugguggaccugggcugcggccgcggcggcuggagcuacuacgccgccaccauccgcaaggugcaggaggugcgcggcuacaccaagggcggccccggccacgaggagcccaugcuggugcagagcuacggcuggaacaucgugcgccugaagagcggcguggacguguuccacauggccgccgagcccugcgacacccugcugugcgacaucggcgagagcagcagcagccccgagguggaggagacccgcacccugcgcgugcugagcauggugggcgacuggcuggagaagcgccccggcgccuucugcaucaaggugcugugccccuacaccagcaccaugauggagaccauggagcgccugcagcgccgccacggcggcggccuggugcgcgugccccugugccgcaacagcacccacgagauguacugggugagcggcgccaagagcaacaucaucaagagcgugagcaccaccagccagcugcugcugggccgcauggacggcccccgccgccccgugaaguacgaggaggacgugaaccugggcagcggcacccgcgccguggccagcugcgccgaggcccccaacaugaagaucaucggccgccgcaucgagcgcauccgcaacgagcacgccgagaccugguuccuggacgagaaccaccccuaccgcaccugggccuaccacggcagcuacgaggcccccacccagggcagcgccagcagccuggugaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugaacaucgugagcagcuggcuguggaaggagcugggcaagcgcaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggaccgcgagcgcgagcaccaccugcgcggcgagugccacagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacauccuggaggagaugaaccgcgcccccggcggcaagauguacgccgacgacaccgccggcugggacacccgcaucagcaaguucgaccuggagaacgaggcccugaucaccaaccagauggaggagggccaccgcacccuggcccuggccgugaucaaguacaccuaccagaacaagguggugaaggugcugcgccccgccgagggcggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgcaagcccgagaaggugacccgcuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcuggagcaacugggaggaggugcccuucugcagccaccacuucaacaagcuguaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcgccgugcccguggacugggugcccaccggccgcaccaccuggagcauccacggcaagggcgaguggaugaccaccgaggacaugcugaugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaaggacaccgugaacauggugcgccgcaucaucggcgacgaggagaaguacauggacuaccugagcacccaggugcgcuaccugggcgaggagggcagcacccccggcgugcug

SEQ ID NO: 229 - RNA, 2124 nt, Artificial Sequence
  ZIKV (strain MR 766) Polyprotein(93-800) CDS mRNA optimized
cgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 230 - RNA, 2124 nt, Artificial Sequence; identical to SEQ ID NO: 229
  ZIKV (strain MR 766) Polyprotein(93-800) CDS mRNA optimized

SEQ ID NO: 231 - RNA, 1341 nt, Artificial Sequence
  ZIKV (strain MR 766) Polyprotein(273-719) CDS mRNA optimized
agccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagc

SEQ ID NO: 232 - RNA, 1341 nt, Artificial Sequence; identical to SEQ ID NO: 231
  ZIKV (strain MR 766) Polyprotein(273-719) CDS mRNA optimized

SEQ ID NO: 233 - RNA, 10489 nt, Artificial Sequence
  ZIKV (strain ZikaSPH2015) complete polyprotein mRNA Design 1 wild type
gggagaaagcuuaccaugaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaucacuucucccuuggagugcuugugauucugcucauggugcaggaagggcugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacgugguggggcugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccaauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaagcccuuagagggcuuccagugcguuauaugacaacagcagucaaugucacccacucuggaacagaaaucgucgacuuaaugugccaugccaccuucacuucacgucuacuacagccaaucagaguccccaacuauaaucuguauauuauggaugaggcccacuucacagaucccucaaguauagcagcaagaggauacauuucaacaaggguugagaugggcgaggcggcugccaucuucaugaccgccacgccaccaggaacccgugacgcauuuccggacuccaacucaccaauuauggacaccgaaguggaagucccagagagagccuggagcucaggcuuugauugggugacggauuauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagagguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuuuuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccaugggauucucaauggacauugaccugcggccagccucagcuugggccaucuaugcugccuugacaacuuucauuaccccagccguccaacaugcagugaccacuucauacaacaacuacuccuuaauggcgauggccacgcaagcuggaguguuguuugguaugggcaaagggaugccauucuacgcaugggacuuuggagucccgcugcuaaugauagguugcuacucacaauuaacgccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauggcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaagguacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucgcauaccaggaggaaggauguaugcagaugacacugcuggcugggacacccgcaucagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguccuagagaugcaagacuuguggcugcugcggaggucagagaaagugaccaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 234 - RNA, 2359 nt, Artificial Sequence
  ZIKV (strain ZikaSPH2015) Polyprotein(93-804) mRNA Design 1 wild type
gggagaaagcuuaccaugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 235 - RNA, 2359 nt, Artificial Sequence
  R4803/R4833 ZIKV (strain ZikaSPH2015) Polyprotein(93-804) mRNA Design 1 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 236 - RNA, 1576 nt, Artificial Sequence
  ZIKV (strain ZikaSPH2015) Polyprotein(273-723) mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 237 - RNA, 10489 nt, Artificial Sequence
  ZIKV (isolate Z1106033) complete polyprotein mRNA Design 1 wild type
gggagaaagcuuaccaugaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaccacuucucccuuggagugcuugugauucugcucauggugcaggaaggguugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacguggugggacugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccuauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaggcccuuagagggcuuccagugcguuauaugacaacagcagucaaugucacccacucuggaacagaaaucgucgacuuaaugugccaugccaccuucacuucgcgucuacuacagccaaucagaguccccaacuauaaucuguauauuauggaugaggcccacuucacagaucccucaaguauagcagcaagaggauacauuucaacaaggguugagaugggcgaggcggccgccaucuucaugaccgccacgccaccaggaacccgugacgcauuuccggacuccaacucaccaauuauggacaccgaaguggaagucccagagagagccuggagcucaggcuuugauugggugacggaucauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagaaguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuucuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccauaggauucucaauggacauugaccugcggccagccucagcuugggccaucuaugcugccuugacaacuuucauuaccccagccguccaacaugcagugaccaccucauacaacaacuacuccuuaauggcgauggccacgcaagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaaggcacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucguauaccaggaggaaggauguaugcagaugacacugcuggcugggacacccgcauuagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguucuagagaugcaagacuuguggcugcugcggaggucagagaaagugacuaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 238 - RNA, 2359 nt, Artificial Sequence
  ZIKV (isolate Z1106033) Polyprotein(93-804) mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 239 - RNA, 2359 nt, Artificial Sequence
  R4815/R4837 ZIKV (isolate Z1106033) Polyprotein(93-804) mRNA Design 1 wild type
gggagaaagcuuaccaugagaauaaucaaugcuaggaaggagaagaagagacgaggcgcagauacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 240 - RNA, 1576 nt, Artificial Sequence
  ZIKV (isolate Z1106033) Polyprotein(273-723) mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 241 - RNA, 10477 nt, Artificial Sequence
  ZIKV (strain MR 766) complete polyprotein mRNA Design 1 wild type
gggagaaagcuuaccaugaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcggggucaaccgaucauauggaccacuucucucuuggagugcuugugauucuacucauggugcaggagggguugaagaagagaaugaccacaaagaucaucaugagcacaucaauggcagugcugguagucaugaucuugggaggauuuucaaugagugaccuggccaagcuugugauccugaugggugcuacuuucgcagaaaugaacacuggaggagauguagcucacuuggcauugguagcggcauuuaaagucagaccagccuugcuggucuccuucauuuucagagccaauuggacaccccgugagagcaugcugcuagcccuggcuucgugucuucugcaaacugcgaucucugcucuugaaggugacuugaugguccucauuaauggauuugcuuuggccugguuggcaauucgagcaauggccgugccacgcacugacaacaucgcucuaccaaucuuggcugcucuaacaccacuagcucgaggcacacugcucguggcauggagagcgggccuggcuacuuguggagggaucaugcuccucucccugaaagggaaagguagugugaagaagaaccugccauuugucauggcccugggauugacagcugugaggguaguagacccuauuaaugugguaggacuacuguuacucacaaggagugggaagcggagcuggcccccuagugaaguucucacagccguuggccugauaugugcacuggccggaggguuugccaaggcagacauugagauggcuggacccauggcugcaguaggcuugcuaauugucagcuauguggucucgggaaagaguguggacauguacauugaaagagcaggugacaucacaugggaaaaggacgcggaagucacuggaaacaguccucggcuugacguggcacuggaugagaguggugacuucuccuugguagaggaagaugguccacccaugagagagaucauacucaaggugguccugauggccaucuguggcaugaacccaauagcuauaccuuuugcugcaggagcgugguauguguaugugaagacugggaaaaggaguggcgcccucugggacgugccugcucccaaagaagugaagaaaggagagaccacagauggaguguacagagugaugacucgcagacugcuagguucaacacagguuggagugggagucaugcaagagggagucuuccacaccauguggcacguuacaaaaggagccgcacugaggagcggugagggaagacuugauccauacuggggggaugucaagcaggacuuggugucauacugugggccuuggaaguuggaugcagcuugggauggacucagcgagguacagcuuuuggccguaccucccggagagagggccagaaacauucagacccugccuggaauauucaagacaaaggacggggacaucggagcaguugcucuggacuacccugcagggaccucaggaucuccgauccuagacaaauguggaagagugauaggacucuauggcaaugggguugugaucaagaauggaagcuauguuagugcuauaacccagggaaagagggaggaggagacuccgguugaauguuucgaacccucgaugcugaagaagaagcagcuaacugucuuggaucugcauccaggagccggaaaaaccaggagaguucuuccugaaauaguccgugaagccauaaaaaagagacuccggacagugaucuuggcaccaacuaggguugucgcugcugagauggaggaggccuugagaggacuuccggugcguuacaugacaacagcagucaacgucacccauucugggacagaaaucguugauuugaugugccaugccacuuucacuucacgcuuacuacaacccaucagagucccuaauuacaaucucaacaucauggaugaagcccacuucacagaccccucaaguauagcugcaagaggauacauaucaacaaggguugaaaugggcgaggcggcugccauuuuuaugacugccacaccaccaggaacccgugaugcguuuccugacucuaacucaccaaucauggacacagaaguggaagucccagagagagccuggagcucaggcuuugauugggugacagaccauucugggaaaacaguuugguucguuccaagcgugagaaacggaaaugaaaucgcagccugucugacaaaggcuggaaagcgggucauacagcucagcaggaagacuuuugagacagaauuucagaaaacaaaaaaucaagagugggacuuugucauaacaacugacaucucagagaugggcgccaacuucaaggcugaccgggucauagacucuaggagaugccuaaaaccagucauacuugauggugagagagucaucuuggcugggcccaugccugucacgcaugcuagugcugcucagaggagaggacguauaggcaggaacccuaacaaaccuggagaugaguacauguauggaggugggugugcagagacugaugaaggccaugcacacuggcuugaagcaagaaugcuucuugacaacaucuaccuccaggauggccucauagccucgcucuaucggccugaggccgauaagguagccgccauugagggagaguuuaagcugaggacagagcaaaggaagaccuucguggaacucaugaagagaggagaccuucccgucuggcuagccuaucagguugcaucugccggaauaacuuacacagacagaagauggugcuuugauggcacaaccaacaacaccauaauggaagacaguguaccagcagagguuuggacaaaguauggagagaagagagugcucaaaccgagauggauggaugcuagggucuguucagaccaugcggcccugaagucguucaaagaauucgccgcuggaaaaagaggagcggcuuugggaguaauggaggcccugggaacacugccaggacacaugacagagagguuucaggaagccauugacaaccucgccgugcucaugcgagcagagacuggaagcaggccuuauaaggcagcggcagcccaacugccggagacccuagagaccauuaugcucuuagguuugcugggaacaguuucacuggggaucuucuucgucuugaugcggaauaagggcaucgggaagaugggcuuuggaaugguaacccuuggggccagugcauggcucauguggcuuucggaaauugaaccagccagaauugcauguguccucauuguuguguuuuuauuacugguggugcucauacccgagccagagaagcaaagaucuccccaagauaaccagauggcaauuaucaucaugguggcagugggccuucuagguuugauaacugcaaacgaacuuggauggcuggaaagaacaaaaaaugacauagcucaucuaaugggaaggagagaagaaggagcaaccaugggauucucaauggacauugaucugcggccagccuccgccugggcuaucuaugccgcauugacaacucucaucaccccagcuguccaacaugcgguaaccacuucauacaacaacuacuccuuaauggcgauggccacacaagcuggagugcuguuuggcaugggcaaagggaugccauuuaugcauggggaccuuggagucccgcugcuaaugauggguugcuauucacaauuaacaccccugacucugauaguagcuaucauucugcuuguggcgcacuacauguacuugaucccaggccuacaagcggcagcagcgcgugcugcccagaaaaggacagcagcuggcaucaugaagaaucccguuguggauggaauagugguaacugacauugacacaaugacaauagacccccagguggagaagaagaugggacaaguguuacucauagcaguagccaucuccagugcugugcugcugcggaccgccuggggauggggggaggcuggagcucugaucacagcagcgaccuccaccuugugggaaggcucuccaaacaaauacuggaacuccucuacagccaccucacugugcaacaucuucagaggaagcuaucuggcaggagcuucccuuaucuauacagugacgagaaacgcuggccugguuaagagacguggaggugggacgggagagacucugggagagaaguggaaagcucgucugaaucagaugucggcccuggaguucuacucuuauaaaaagucagguaucacugaaguguguagagaggaggcucgccgugcccucaaggauggaguggccacaggaggacaugccguaucccggggaagugcaaagaucagaugguuggaggagagaggauaucugcagcccuaugggaagguuguugaccucggauguggcagagggggcuggagcuauuaugccgccaccauccgcaaagugcaggaggugagaggauacacaaagggaggucccggucaugaagaacccaugcuggugcaaagcuauggguggaacauaguucgucucaagaguggaguggacgucuuccacauggcggcugagccgugugacacucugcugugugacauaggugagucaucaucuaguccugaaguggaagagacacgaacacucagagugcucucuauggugggggacuggcuugaaaaaagaccaggggccuucuguauaaaggugcugugcccauacaccagcacuaugauggaaaccauggagcgacugcaacguaggcaugggggaggauuagucagagugccauugugucgcaacuccacacaugagauguacugggucucuggggcaaagagcaacaucauaaaaaguguguccaccacaagucagcuccuccugggacgcauggauggccccaggaggccagugaaauaugaggaggaugugaaccucggcucggguacacgagcuguggcaagcugugcugaggcuccuaacaugaaaaucaucggcaggcgcauugagagaauccgcaaugaacaugcagaaacaugguuucuugaugaaaaccacccauacaggacaugggccuaccaugggagcuacgaagcccccacgcaaggaucagcgucuucccucgugaacgggguuguuagacuccugucaaagccuugggacguggugacuggaguuacaggaauagccaugacugacaccacaccauacggccaacaaagagucuucaaagaaaaaguggacaccagggugccagauccccaagaaggcacucgccagguaaugaacauagucucuuccuggcuguggaaggagcuggggaaacgcaagcggccacgcgucugcaccaaagaagaguuuaucaacaaggugcgcagcaaugcagcacugggagcaauauuugaagaggaaaaagaauggaagacggcuguggaagcugugaaugauccaagguuuugggcccuaguggauagggagagagaacaccaccugagaggagagugucacagcuguguguacaacaugaugggaaaaagagaaaagaagcaaggagaguucgggaaagcaaaagguagccgcgccaucugguacaugugguugggagccagauucuuggaguuugaagcccuuggauucuugaacgaggaccauuggaugggaagagaaaacucaggagguggagucgaaggguuaggauugcaaagacuuggauacauucuagaagaaaugaaucgggcaccaggaggaaagauguacgcagaugacacugcuggcugggacacccgcauuaguaaguuugaucuggagaaugaagcucugauuaccaaccaaauggaggaagggcacagaacucuggcguuggccgugauuaaauacacauaccaaaacaaaguggugaagguucucagaccagcugaaggaggaaaaacaguuauggacaucauuucaagacaagaccagagagggaguggacaaguugucacuuaugcucucaacacauucaccaacuugguggugcagcuuauccggaacauggaagcugaggaaguguuagagaugcaagacuuaugguuguugaggaagccagagaaagugaccagaugguugcagagcaauggaugggauagacucaaacgaauggcggucaguggagaugacugcguugugaagccaaucgaugauagguuugcacaugcccucagguucuugaaugacaugggaaaaguuaggaaagacacacaggaguggaaacccucgacuggauggagcaauugggaagaagucccguucugcucccaccacuucaacaagcuguaccucaaggaugggagauccauuguggucccuugccgccaccaagaugaacugauuggccgagcucgcgucucaccaggggcaggauggagcauccgggagacugccugucuugcaaaaucauaugcgcagauguggcagcuccuuuauuuccacagaagagaccuucgacugauggcuaaugccauuugcucggcugugccaguugacuggguaccaacugggagaaccaccuggucaauccauggaaagggagaauggaugaccacugaggacaugcucaugguguggaauagaguguggauugaggagaacgaccauauggaggacaagacuccuguaacaaaauggacagacauucccuaucuaggaaaaagggaggacuuaugguguggaucccuuauagggcacagaccccgcaccacuugggcugaaaacaucaaagacacagucaacauggugcgcaggaucauaggugaugaagaaaaguacauggacuaucuauccacccaaguccgcuacuugggugaggaaggguccacacccggaguguuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 242 - RNA, 2347 nt, Artificial Sequence
  ZIKV (strain MR 766) Polyprotein(93-800) mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 243 - RNA, 2347 nt, Artificial Sequence
  R4819/R4841 ZIKV (strain MR 766) Polyprotein(93-800) mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 244 - RNA, 1564 nt, Artificial Sequence
  ZIKV (strain MR 766) Polyprotein(273-719) mRNA Design 1 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 245 - RNA, 1564 nt, Artificial Sequence
  ZIKV (strain MR 766) Polyprotein(273-719) mRNA Design 1 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 246 - RNA, 10489 nt, Artificial Sequence
  ZIKV (strain ZikaSPH2015) complete polyprotein mRNA Design 1 GC
gggagaaagcuuaccaugaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcggggagcaccgaccacauggaccacuucagccugggcguccucgugauccugcugauggugcaggaggggcucaagaagcgcaugacgaccaagaucaucaucuccaccagcauggccguccugguggccaugauccugggcggguucuccaugagcgaccucgccaagcuggccauccugaugggcgcgaccuucgccgagaugaacaccggcggggacguggcccaccucgcccugaucgccgcguucaagguccgccccgcccugcucguguccuucaucuuccgggccaacuggacgccccgcgagagcaugcugcuggcccucgcguccugccugcugcagaccgccaucagcgcccucgagggcgaccugauggugcugaucaacggguucgcccucgccuggcuggcgauccgggccauggucgugccgcgcaccgacaacaucacccuggccauccucgccgcccugacgccccuggcgcggggcacccuccugguggccuggcgcgccgggcuggccacgugcggcggcuucaugcuccugucccugaaggggaagggcagcgucaagaagaaccuccccuucgugauggcccuggggcugaccgcggugcggcucgucgaccccaucaacguggugggccugcugcuccugacgcgcuccgggaagcggagcuggccgcccuccgagguccugaccgccgugggccucaucugcgcccuggccggcggguucgcgaaggccgacaucgagauggccggccccauggccgccguggggcugcucaucgucagcuacgugguguccggcaagagcgucgacauguacaucgagcgcgcgggggacaucaccugggagaaggacgccgaggugaccggcaacuccccgcggcuggacguggcccuggacgagagcggcgacuucucccucgucgaggacgacgggccgcccaugcgcgagaucauccugaagguggugcugaugacgaucugcggcaugaaccccaucgccaucccguucgccgcgggggccugguacgucuacgugaagaccggcaagcggagcggcgcccugugggacgugcccgcccccaaggaggucaagaagggggagaccaccgacggcguguaccgcgugaugacgcggcgccuccuggggagcacccaggucggcgugggggugaugcaggagggcgucuuccacaccauguggcacgugaccaagggcuccgcccugcggagcggggagggccgccucgaccccuacuggggcgacgugaagcaggaccuggucuccuacugcgggccguggaagcuggacgcggccugggacgggcacagcgaggugcagcuccuggccgugcccccgggcgagcgggcccgcaacauccagacgcugcccggcaucuucaagaccaaggacggggacaucggcgcggucgcccucgacuacccggccgggaccuccggcagccccauccuggacaagugcgggcgcgugaucggccuguacggcaacgggguggucaucaagaacggcuccuacgugagcgccaucacccaggggcggcgcgaggaggagacgcccgucgagugcuucgagcccuccaugcucaagaagaagcagcugaccgugcuggaccuccacccgggcgccgggaagacccggcgcgugcugcccgagaucguccgggaggcgaucaagacccgccugcggacggugauccucgcccccacccgcguggucgccgccgagauggaggaggcccugcggggccugcccgugcgcuacaugaccaccgcggugaacgucacgcacagcggcaccgagaucguggaccucaugugccacgccaccuucaccucccggcugcugcagccgauccgcgugcccaacuacaaccucuacaucauggacgaggcccacuucacggaccccagcuccaucgccgcccggggguacaucagcacccgcgucgagaugggcgaggcggccgccaucuucaugaccgccaccccgccggggacccgggacgccuuccccgacuccaacagccccaucauggacacggagguggaggugcccgagcgcgcgugguccagcggcuucgacugggucaccgacuacuccggcaagaccgugugguucgugccgagcguccggaacgggaacgagaucgccgccugccugaccaaggccggcaagcgcgugauccagcugagccggaagacguucgagaccgaguuccagaagaccaagcaccaggagugggacuucguggucaccacggacaucuccgagaugggggcgaacuucaaggccgaccgcgugaucgacagccggcgcugccucaagcccgugauccuggacggcgagcgcgucauccuggccgggcccaugcccgugacccacgccuccgccgcgcagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgccagccucuaccgccccgaggcggacaagguggccgccaucgagggcgaguucaagcugcggaccgagcagcgcaagacguucgucgagcugaugaagcggggcgaccucccgguguggcuggccuaccagguggccuccgcggggaucaccuacaccgaccgccgguggugcuucgacggcaccacgaacaacaccaucauggaggacagcguccccgccgagguguggacccgccacggggagaagcgggugcugaagccccgcuggauggacgcccgggucugcuccgaccacgccgcgcucaagagcuucaaggaguucgccgccggcaagcgcggggccgccuucggcgugauggaggcgcugggcacccugcccgggcacaugacggagcgguuccaggaggccaucgacaaccucgccgugcugaugcgcgccgagaccggcucccggccguacaaggccgcggccgcccagcugcccgagacccucgagaccaucaugcugcuggggcuccugggcacggucagccugggcaucuucuucgugcucaugcgcaacaaggggaucggcaagaugggguucggcauggugacccugggggccuccgccuggcugauguggcucagcgagaucgagcccgcgcgcaucgccugcguccugaucgugguguuccugcuccuggucgugcugauccccgagccggagaagcagcgguccccgcaggacaaccagauggccaucaucaucaugguggccgucggccuccugggccugaucaccgcgaacgagcucggguggcuggagcgcaccaagagcgaccugucccaccucaugggccggcgcgaggagggggccacgaugggcuucagcauggacaucgaccugcggcccgccuccgccugggccaucuacgcggcccugaccaccuucaucacccccgccgugcagcacgccgugacgaccagcuacaacaacuacucccucauggccauggcgacccaggccgggguccuguucggcaugggcaaggggaugccguucuacgccugggacuucggcgugccgcugcucaugaucgggugcuacagccagcugaccccgcugacgcucaucguggccaucauccugcuggucgcccacuacauguaccucauccccggccugcaggcggccgccgcccgcgccgcgcagaagcggaccgccgccgggaucaugaagaacccgguggucgacggcaucguggugaccgacaucgacaccaugacgaucgacccccaggucgagaagaagaugggccaggugcugcucauggccguggcggucagcuccgccauccugagccgcaccgccuggggguggggcgaggccggggcccugaucaccgcggccaccuccacccucugggagggcagccccaacaaguacuggaacuccagcacggccaccucccugugcaacaucuuccgggggagcuaccuggccggcgccucccucaucuacaccgugacccgcaacgcgggccuggugaagcggcgcgggggcgggacgggcgagacccugggcgagaaguggaaggcccggcucaaccagaugagcgcccuggaguucuacuccuacaagaagagcgggaucaccgaggucugccgcgaggaggcccggcgcgcccugaaggacggcguggcgaccgggggccacgccgugucccgggggagcgccaagcuccgcuggcuggucgagcggggcuaccugcagcccuacggcaaggugaucgaccuggggugcggccgcgggggcugguccuacuacgccgcgacgauccggaaggugcaggaggucaagggguacaccaagggcggcccggggcacgaggagcccgugcucgugcagagcuacggcuggaacaucguccgccugaaguccgggguggacguguuccacauggccgccgagcccugcgacacccugcucugcgacaucggcgagagcuccagcagccccgaggucgaggaggcccgcacccugcgggugcuguccauggugggggacuggcucgagaagcgcccgggcgccuucugcaucaagguccugugccccuacacgagcaccaugauggagacccuggagcggcuccagcgccgguacggcgggggccuggugcgcgugccccugucccggaacagcacccacgagauguacugggucuccggggcgaagagcaacacgaucaaguccgugagcaccaccucccagcuccugcugggccgcauggacggcccccggcgcccggugaaguacgaggaggacgucaaccucgggagcggcacccgggccgugguguccugcgccgaggcccccaacaugaagaucaucgggaaccgcaucgagcggauccgcagcgagcacgccgagacgugguucuucgacgagaaccaccccuaccggaccugggcguaccacggcuccuacgaggccccgacccaggggagcgccuccagccugaucaacggcgucgugcgccugcucuccaagcccugggacguggucaccggcgugacggggaucgccaugaccgacaccacccccuacggccagcagcggguguucaaggagaaggucgacacgcgcgugcccgacccgcaggaggggacccgccaggugaugagcauggucagcuccuggcuguggaaggagcugggcaagcacaagcgcccccgcgugugcaccaaggaggaguucaucaacaaggugcggagcaacgccgcgcucggggccaucuucgaggaggagaaggaguggaagaccgccgucgaggccgugaacgacccccgcuucugggcccugguggacaaggagcgggagcaccaccuccgcggcgagugccaguccugcgucuacaacaugaugggcaagcgggagaagaagcagggggaguucggcaaggcgaaggggagccgcgccaucugguacauguggcucggcgcccgguuccuggaguucgaggcccugggguuccucaacgaggaccacuggaugggccgcgagaacuccggcgggggcguggaggggcugggccugcagcggcucggguacgugcuggaggagaugagccgcauccccggcggccggauguacgcggacgacacggccgggugggacacccgcaucucccgguucgaccuggagaacgaggcccucaucaccaaccagauggagaagggccaccgcgcccuggcccuggcgaucaucaaguacaccuaccagaacaaggucgugaagguccuccggccggccgagaaggggaagacggugauggacaucaucagccgccaggaccagcggggcuccggccagguggucaccuacgcccugaacaccuucaccaaccugguggugcagcucauccgcaacauggaggccgaggagguccuggagaugcaggaccuguggcuccugcggcgcagcgagaaggugaccaacuggcugcaguccaacgggugggaccggcucaagcgcauggccgugagcggcgacgacugcgucgugaagcccaucgacgaccgcuucgcgcacgcccugcgguuccugaacgacauggggaaggugcgcaaggacacgcaggaguggaagcccuccaccggcugggacaacugggaggagguccccuucugcagccaccacuucaacaagcuccaccugaaggacgggcgguccaucguggugccgugccgccaccaggacgagcugaucggccgggcccgcgucagccccggcgccgggugguccauccgggagaccgccugccucgcgaagagcuacgcccagauguggcagcugcuguacuuccaccgccgggaccuccgccugauggccaacgccaucugcuccagcgugcccguggacuggguccccaccggccggacgaccuggagcauccacgggaagggcgaguggaugaccaccgaggacaugcuggugguguggaaccgcgucuggaucgaggagaacgaccacauggaggacaagacgccggugaccaaguggaccgacauccccuaccucgggaagcgggaggaccuguggugcggcucccugaucggccaccgcccccggaccacgugggcggagaacaucaagaacaccgugaacaugguccgccggaucaucggggacgaggagaaguacauggacuaccucagcacccaggugcgcuaccugggcgaggagggguccacccccggcgugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 247 - RNA, 2359 nt, Artificial Sequence
  R4804/R4834 ZIKV (strain ZikaSPH2015) Polyprotein(93-804) mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 248 - RNA, 2359 nt, Artificial Sequence
  ZIKV (strain ZikaSPH2015) Polyprotein(93-804) mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacaucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcaccccgcacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcacggcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgccguucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccugaacucccucgggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 249 - RNA, 1576 nt, Artificial Sequence
  R4826/R4846 ZIKV (strain ZikaSPH2015) Polyprotein(273-723) mRNA Design 1 GC
gggagaaagcuuaccaugagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 250 - RNA, 1576 nt, Artificial Sequence
  ZIKV (strain ZikaSPH2015) Polyprotein(273-723) mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacaucgugcuggagcacggcgggugcgugaccgucauggcgcaggacaagccgacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcucuucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaacccggugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 251 - RNA, 10489 nt, Artificial Sequence
  ZIKV (isolate Z1106033) complete polyprotein mRNA Design 1 GC
gggagaaagcuuaccaugaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgccgggagcaccgaccacauggaccacuucagccugggcgugcucgugauccugcugaugguccaggaggggcucaagaagcgcaugacgaccaagaucaucaucuccaccagcauggccgugcugguggccaugauccugggcggguucuccaugagcgaccucgccaagcuggcgauccugaugggcgccaccuucgccgagaugaacaccggcggggacgucgcccaccucgcccugaucgcggccuucaaggugcgccccgcccugcucguguccuucaucuuccgggccaacuggacgccccgcgagagcaugcugcuggcgcucgccuccugccugcugcagaccgccaucagcgcccucgagggcgaccugaugguccugaucaacggguucgcccucgcguggcuggccauccgggccaugguggugccgcgcaccgacaacaucacccuggccauccucgccgcgcugacgccccuggcccggggcacccuccuggucgccuggcgcgccgggcuggccacgugcggcggcuucaugcuccugucccugaaggggaagggcagcgugaagaagaaccuccccuucgugauggcgcuggggcugaccgccguccggcucguggaccccaucaacguggucggccugcugcuccugacgcgcuccgggaagcggagcuggccgcccuccgaggugcugaccgccgugggccucaucugcgcccuggcgggcggguucgccaaggccgacaucgagauggccggccccauggccgcggucgggcugcucaucgugagcuacguggucuccggcaagagcguggacauguacaucgagcgcgccggggacaucaccugggagaaggacgccgaggugaccggcaacuccccgcggcuggacgucgcccuggacgagagcggcgacuucucccucguggaggacgacgggccgcccaugcgcgagaucauccugaaggugguccugaugacgaucugcggcaugaaccccaucgccaucccguucgcggccggggccugguacguguacgugaagaccggcaagcggagcggcgcccugugggacguccccgcccccaaggaggugaagaagggggagaccaccgacggcguguaccgcgucaugacgcggcgccuccuggggagcacccaggugggcgugggggucaugcaggagggcguguuccacaccauguggcacgugaccaagggcuccgcgcugcggagcggggagggccgccucgaccccuacuggggcgacgucaagcaggaccugguguccuacugcgggccguggaagcuggacgccgccugggacgggcacagcgaggugcagcuccuggccgucccgcccggcgagcgggcgcgcaacauccagacgcugcccggcaucuucaagaccaaggacggggacaucggcgccguggcccucgacuacccggccgggaccuccggcagccccauccuggacaagugcgggcgcgugaucggccuguacggcaacggggucgugaucaagaacggcuccuacgucagcgccaucacccaggggcggcgcgaggaggagacgcccguggagugcuucgagcccuccaugcucaagaagaagcagcugaccgugcuggaccuccacccgggcgcggggaagacccggcgcguccugcccgagaucgugcgggaggccaucaagacccgccugcggacggugauccucgcccccacccgcgucguggccgccgagauggaggaggcgcugcggggccugcccgugcgcuacaugaccaccgccgucaacgugacgcacagcggcaccgagaucguggaccucaugugccacgccaccuucaccucccggcugcugcagccgauccgcguccccaacuacaaccucuacaucauggacgaggcccacuucacggaccccagcuccaucgccgcgcggggguacaucagcacccgcguggagaugggcgaggccgccgccaucuucaugaccgccaccccgccggggacccgggacgcguuccccgacuccaacagccccaucauggacacggagguggagguccccgagcgcgccugguccagcggcuucgacugggugaccgaccacuccggcaagaccgugugguucgucccgagcgugcggaacgggaacgagaucgccgccugccugaccaaggcgggcaagcgcgugauccagcugagccggaagacguucgagaccgaguuccagaagaccaagcaccaggagugggacuucgucgugaccacggacaucuccgagaugggggccaacuucaaggccgaccgcgugaucgacagccggcgcugccucaagcccgucauccuggacggcgagcgcgugauccuggccgggcccaugcccgugacccacgccuccgcggcccagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgcgagccucuaccgccccgaggccgacaaggucgccgccaucgagggcgaguucaagcugcggaccgagcagcgcaagacguucguggagcugaugaagcggggcgaccucccgguguggcuggccuaccaggucgcguccgccgggaucaccuacaccgaccgccgguggugcuucgacggcaccacgaacaacaccaucauggaggacagcgugcccgccgagguguggacccgccacggggagaagcggguccugaagccccgcuggauggacgcccgggugugcuccgaccacgcggcccucaagagcuucaaggaguucgccgccggcaagcgcggggccgcguucggcgugauggaggcccugggcacccugcccgggcacaugacggagcgguuccaggaggccaucgacaaccucgccguccugaugcgcgccgagaccggcucccggccguacaaggcggccgccgcccagcugcccgagacccucgagaccaucaugcugcuggggcuccugggcacggugagccugggcaucuucuucgugcucaugcgcaacaaggggaucggcaagaugggguucggcauggucacccugggggccuccgcguggcugauguggcucagcgagaucgagcccgcccgcaucgccugcgugcugaucguggucuuccugcuccugguggugcugauccccgagccggagaagcagcgguccccgcaggacaaccagauggccaucaucaucauggucgcggugggccuccugggccugaucaccgccaacgagcucggguggcuggagcgcaccaagagcgaccugucccaccucaugggccggcgcgaggagggggccacgaucggcuucagcauggacaucgaccugcggcccgccuccgccugggcgaucuacgccgcccugaccaccuucaucacccccgccgugcagcacgccgucacgaccagcuacaacaacuacucccucauggcgauggccacccaggccggggugcuguucggcaugggcaaggggaugccguucuacgccugggacuucggcgugccccugcucaugaucgggugcuacagccagcugaccccgcugacgcucaucgucgccaucauccugcugguggcgcacuacauguaccucauccccggccugcaggccgccgccgcccgcgcggcccagaagcggaccgccgccgggaucaugaagaacccggucguggacggcaucguggucaccgacaucgacaccaugacgaucgacccccagguggagaagaagaugggccaggugcugcucaucgcggucgccgugagcuccgccauccugagccgcaccgccuggggguggggcgaggccggggcgcugaucaccgccgccaccuccacccucugggagggcagccccaacaaguacuggaacuccagcacggccaccucccugugcaacaucuuccgggggagcuaccuggccggcgcgucccucaucuacaccgugacccgcaacgccggccuggucaagcggcgcgggggcgggacgggcgagacccugggcgagaaguggaaggcccggcucaaccagaugagcgcccuggaguucuacuccuacaagaagagcgggaucaccgaggugugccgcgaggaggcccggcgcgcgcugaaggacggcguggccaccgggggccacgccgucucccgggggagcgccaagcuccgcuggcugguggagcggggcuaccugcagcccuacggcaaggugaucgaccuggggugcggccgcgggggcugguccuacuacgcggccacgauccggaagguccaggaggugaagggguacaccaagggcggcccggggcacgaggagcccgugcucguccagagcuacggcuggaacaucgugcgccugaaguccgggguggacgucuuccacauggccgccgagcccugcgacacccugcucugcgacaucggcgagagcuccagcagccccgagguggaggaggcccgcacccugcgggugcuguccauggucggggacuggcucgagaagcgcccgggcgcguucugcaucaaggugcugugccccuacacgagcaccaugauggagacccuggagcggcuccagcgccgguacggcgggggccuggugcgcgucccccugucccggaacagcacccacgagauguacuggguguccggggccaagagcaacacgaucaaguccgugagcaccaccucccagcuccugcugggccgcauggacggcccccggcgcccggucaaguacgaggaggacgugaaccucgggagcggcacccgggccguggucuccugcgccgaggcccccaacaugaagaucaucgggaaccgcaucgagcggauccgcagcgagcacgcggagacgugguucuucgacgagaaccaccccuaccggaccugggccuaccacggcuccuacgaggccccgacccaggggagcgccuccagccugaucaacggcguggugcgccugcucuccaagcccugggacgucgugaccggcgugacggggaucgccaugaccgacaccacccccuacggccagcagcgggucuucaaggagaagguggacacgcgcgugcccgacccgcaggaggggacccggcaggucaugagcauggugagcuccuggcuguggaaggagcugggcaagcacaagcgcccccgcgugugcaccaaggaggaguucaucaacaagguccggagcaacgcggcccucggggccaucuucgaggaggagaaggaguggaagaccgccguggaggccgugaacgacccccgcuucugggcgcuggucgacaaggagcgggagcaccaccuccgcggcgagugccaguccugcguguacaacaugaugggcaagcgggagaagaagcagggggaguucggcaaggccaaggggagccgcgccaucugguacauguggcucggcgcccgguuccuggaguucgaggcgcugggguuccucaacgaggaccacuggaugggccgcgagaacuccggcgggggcguggaggggcugggccugcagcggcucggguacguccuggaggagaugagccgcauccccggcggccggauguacgccgacgacacggccgggugggacacccgcaucucccgguucgaccuggagaacgaggcccucaucaccaaccagauggagaagggccaccgcgcccuggcgcuggccaucaucaaguacaccuaccagaacaagguggucaaggugcuccggccggccgagaaggggaagacggugauggacaucaucagccgccaggaccagcggggcuccggccaggucgugaccuacgcccugaacaccuucaccaaccuggugguccagcucauccgcaacauggaggccgaggaggugcuggagaugcaggaccuguggcuccugcggcgcagcgagaaggugaccaacuggcugcaguccaacgggugggaccggcucaagcgcauggcggucagcggcgacgacugcguggugaagcccaucgacgaccgcuucgcccacgcccugcgguuccugaacgacauggggaagguccgcaaggacacgcaggaguggaagcccuccaccggcugggacaacugggaggaggugcccuucugcagccaccacuucaacaagcuccaccugaaggacgggcgguccaucguggucccgugccgccaccaggacgagcugaucggccgggcccgcgugagccccggcgccgggugguccauccgggagaccgcgugccucgccaagagcuacgcccagauguggcagcugcuguacuuccaccgccgggaccuccgccugauggccaacgcgaucugcuccagcgugcccgucgacugggugcccaccggccggacgaccuggagcauccacgggaagggcgaguggaugaccaccgaggacaugcugguggucuggaaccgcguguggaucgaggagaacgaccacauggaggacaagacgccggugaccaaguggaccgacauccccuaccucgggaagcgggaggaccuguggugcggcucccugaucggccaccgcccccggaccacgugggccgagaacaucaagaacaccgucaacauggugcgccggaucaucggggacgaggagaaguacauggacuaccucagcacccaggugcgcuaccugggcgaggagggguccacccccggcguccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 252 - RNA, 2359 nt, Artificial Sequence
  R4816/R4838 ZIKV (isolate Z1106033) Polyprotein(93-804) mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 253 - RNA, 2359 nt, Artificial Sequence
  ZIKV (isolate Z1106033) Polyprotein(93-804) mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcaccccgcacuggaacaacaaggaggcgcugguggaguucaaggacgcccacgccaagcggcagaccgucguggugcucgggucccaggagggcgccguccacacggcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgccguucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgugggcggcgcccugaacucccucgggaaggggauccaccagaucuucggcgccgcguucaagagccuguucgggggcauguccugguucagccagauccugaucgggacgcuccugauguggcugggccucaacgccaagaacggguccaucagccugaugugccuggcccucggcggcgugcugaucuuccuguccaccgccgucagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 254 - RNA, 1576 nt, Artificial Sequence
  R4825/R4845 ZIKV (isolate Z1106033) Polyprotein(273-723) mRNA Design 1 GC
gggagaaagcuuaccaugagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 255 - RNA, 1576 nt, Artificial Sequence
  ZIKV (isolate Z1106033) Polyprotein(273-723) mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaacccggugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 256 - RNA, 10477 nt, Artificial Sequence
  ZIKV (strain MR 766) complete polyprotein mRNA Design 1 GC
gggagaaagcuuaccaugaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgccggcagcacggaccacauggaccacuucucccugggcgugcuggucauccuccugauggugcaggaggggcugaagaagcggaugaccaccaagaucaucaugagcaccagcauggccgugcucgucgugaugauccugggcggguucuccaugagcgaccuggccaagcucgugauccugaugggcgcgaccuucgccgagaugaacacgggcggcgacgucgcccaccuggcccucguggccgcguucaaggugcgccccgcccugcuggucuccuucaucuuccgggccaacuggaccccgcgcgagagcaugcuccuggcccuggccuccugccuccugcagaccgcgaucagcgcccuggagggggaccucauggugcugaucaacggguucgcccuggccuggcucgcgauccgggccauggccgugccccgcaccgacaacaucgcccugccgauccuggccgcgcucacgccccuggcccggggcacccugcucgucgccuggcgcgccgggcuggccacgugcggcgggaucaugcugcucucccugaagggcaagggcagcgugaagaagaaccugcccuucgugauggcgcucgggcugaccgccguccgggugguggaccccaucaacgucgugggccugcuccugcugacgcgcuccgggaagcggagcuggccgcccuccgaggugcucaccgccgucggccugaucugcgcccuggccgggggcuucgcgaaggccgacaucgagauggccggccccauggccgcgguggggcuccugaucgugagcuacgucguguccggcaagagcguggacauguacaucgagcgcgccggggacaucaccugggagaaggacgccgaggucaccggcaacuccccgcggcuggacguggcccucgacgagagcggggacuucucccugguggaggaggacggcccgcccaugcgcgagaucauccugaaggucgugcucauggccaucugcggcaugaaccccaucgcgaucccguucgccgccggggccugguacguguacgucaagacgggcaagcggagcggggcccugugggacgugcccgcgcccaaggaggugaagaagggcgagaccaccgacggcgucuaccgcgugaugacccggcgccugcugggguccacccaggugggcgucggggugaugcaggagggcguguuccacaccauguggcacgucaccaagggggccgcccuccggagcggcgagggccgccuggaccccuacuggggcgacgugaagcaggaccuggucagcuacugcgggccguggaagcucgacgccgccugggacgggcuguccgaggugcagcugcucgcggugccgcccggcgagcgcgcccggaacauccagacccugcccgggaucuucaagacgaaggacggcgacaucggcgccgucgcccuggacuacccggcggggaccagcggcucccccauccucgacaagugcgggcgcgugaucggccuguacgggaacggcguggucaucaagaacggcagcuacguguccgccaucacccaggggaagcgggaggaggagacccccguggagugcuucgagcccagcaugcugaagaagaagcagcucacgguccuggaccugcacccgggcgccgggaagacccgccgggugcuccccgagaucgugcgcgaggccaucaagaagcggcugcgcaccgucauccuggcccccacccgggugguggcggccgagauggaggaggcccuccgcggccugcccguccgguacaugacgaccgccgugaacgugacccacuccgggaccgagaucgucgaccugaugugccacgccacguucaccagccgccuccugcagccgauccgggugcccaacuacaaccugaacaucauggacgaggcgcacuucaccgaccccuccagcaucgccgcccgcggcuacaucuccacccggguggagaugggcgaggccgccgcgaucuucaugacggccaccccgccggggacccgcgacgccuuccccgacagcaacucccccaucauggacaccgaggucgaggugcccgagcgggccuggagcuccggcuucgacugggugaccgaccacagcgggaagacggucugguucgugccguccgugcgcaacggcaacgagaucgccgcgugccucaccaaggccggcaagcgggucauccagcugagccgcaagaccuucgagaccgaguuccagaagacgaagaaccaggagugggacuucgugaucaccaccgacaucuccgagaugggggccaacuucaaggccgaccgggugaucgacagccgccgcugccugaagcccgucauccucgacggcgagcgggugauccuggcggggcccaugcccgugacccacgccagcgccgcccagcgccggggccgcaucgggcggaacccgaacaagcccggcgacgaguacauguacggcgggggcugcgccgagacggacgaggggcacgcgcacuggcuggaggcccgcaugcuccuggacaacaucuaccugcaggacggccucaucgccucccuguaccggcccgaggccgacaaggucgccgcgaucgagggggaguucaagcugcgcaccgagcagcggaagaccuucguggagcucaugaagcgcggcgaccugccgguguggcuggccuaccaggucgccagcgccggcaucaccuacacggaccggcgcuggugcuucgacgggaccaccaacaacaccaucauggaggacuccgugcccgccgagguguggacgaaguacggcgagaagcggguccucaagccccgcuggauggacgcgcgggugugcagcgaccacgccgcccugaaguccuucaaggaguucgccgcggggaagcgcggcgccgcccugggggugauggaggcccucggcacccugcccggccacaugaccgagcgguuccaggaggccaucgacaaccuggcgguccucaugcgcgccgagaccgggagccggccguacaaggccgccgccgcgcagcugcccgagacgcuggagaccaucaugcuccugggccugcucgggaccgugucccugggcaucuucuucgugcugaugcgcaacaagggcaucgggaagaugggcuucgggauggucacccucggcgccagcgccuggcugauguggcuguccgagaucgagcccgcccgcaucgccugcgugcucaucguggucuuccugcugcucguggugcugauccccgagccggagaagcagcggagcccccaggacaaccagauggcgaucaucaucauggucgccguggggcugcucggccugaucacggccaacgagcugggcuggcucgagcgcaccaagaacgacaucgcccaccugauggggcggcgcgaggagggcgcgaccaugggguucuccauggacaucgaccugcggcccgccagcgccugggccaucuacgccgcgcucaccacgcugaucacccccgccguccagcacgccgugaccaccuccuacaacaacuacagccugauggccauggccacgcaggcgggcgugcucuucgggaugggcaagggcaugccguucaugcacggggaccugggcgucccgcugcucaugauggggugcuacucccagcugaccccgcugacccucaucguggccaucauccugcugguggcccacuacauguaccucauccccggccugcaggccgccgcggcccgcgccgcccagaagcggaccgccgcggggaucaugaagaacccggucguggacggcaucguggucacggacaucgacaccaugaccaucgacccccagguggagaagaagaugggccaggugcugcucaucgccgucgccaucagcuccgccgugcugcugcgcaccgcguggggguggggcgaggccggggcccucaucacggccgccaccagcacccugugggagggcucccccaacaaguacuggaacagcagcaccgcgaccucccugugcaacaucuuccgggggagcuaccucgccggcgccucccugaucuacacggugacccgcaacgccggccuggucaagcggcgcgggggcgggaccggcgagacccucggcgagaaguggaaggcccggcugaaccagaugagcgcgcuggaguucuacuccuacaagaagagcgggaucacggaggugugccgcgaggaggcccggcgcgcccucaaggacggcguggccaccgggggccacgccgucucccgggggagcgcgaagauccgcuggcuggaggagcggggcuaccugcagcccuacggcaaggugguggaccuggggugcggccgcgggggcugguccuacuacgccgccaccauccggaagguccaggaggugcgcggguacaccaagggcggcccggggcacgaggagcccaugcucgugcagagcuacggcuggaacaucguccgccugaaguccgggguggacguguuccacauggccgcggagcccugcgacacgcugcucugcgacaucggcgagagcuccagcucccccgaggucgaggagacccggacccugcgcgugcugagcauggugggggacuggcucgagaagcggccgggcgccuucugcaucaagguccugugccccuacaccuccacgaugauggagaccauggagcgccugcagcggcgccacggcgggggccucgugcgggugccccugugccgcaacagcacccacgagauguacugggucuccggggccaagagcaacaucaucaagagcguguccaccacgagccagcugcuccugggccggauggacggcccccgccggccggugaaguacgaggaggacgucaaccugggguccggcacccgcgccguggccagcugcgcggaggcccccaacaugaagaucaucgggcggcgcaucgagcggauccgcaacgagcacgccgagaccugguuccucgacgagaaccaccccuaccggaccugggccuaccacggcuccuacgaggccccgacgcaggggagcgcguccagccuggugaacggcgucgugcgccugcucuccaagcccugggacguggucaccggcgugaccgggaucgccaugaccgacacgacccccuacggccagcagcggguguucaaggagaaggucgacacccgcgugcccgacccgcaggaggggacccgccaggugaugaacaucgucagcuccuggcuguggaaggagcugggcaagcggaagcgcccccgggugugcacgaaggaggaguucaucaacaaggugcgcagcaacgccgcccucggggccaucuucgaggaggagaaggaguggaagaccgcggucgaggccgugaacgacccccgguucugggcccuggucgaccgcgagcgggagcaccaccuccgcggcgagugccacuccugcguguacaacaugaugggcaagcgggagaagaagcagggggaguucggcaaggccaaggggagccgcgccaucugguacauguggcucggcgcgcgguuccuggaguucgaggcccugggguuccucaacgaggaccacuggaugggccgcgagaacuccggcgggggcguggaggggcugggccugcagcggcucggguacauccuggaggagaugaaccgcgcccccggcggcaagauguacgccgacgacaccgcggggugggacacccggaucagcaaguucgaccuggagaacgaggcccucaucacgaaccagauggaggagggccaccgcacccuggcccuggccgucaucaaguacaccuaccagaacaagguggugaagguccuccggccggccgagggcgggaagaccgugauggacaucaucucccgccaggaccagcggggcagcggccagguggucacguacgcgcugaacaccuucaccaaccugguggugcagcucauccgcaacauggaggccgaggagguccuggagaugcaggaccuguggcuccugcggaagcccgagaaggugacccgcuggcugcagagcaacggcugggaccgccucaagcggauggccguguccggggacgacugcgucgugaagcccaucgacgaccgcuucgcccacgcccugcgguuccugaacgacaugggcaaggugcgcaaggacacccaggaguggaagcccagcacggggugguccaacugggaggaggucccguucugcagccaccacuucaacaagcucuaccugaaggacggccgguccaucguggugcccugccgccaccaggacgagcugaucggccgggcgcgcgucagccccggggccggcugguccauccgggagaccgccugccucgccaagagcuacgcccagauguggcagcugcuguacuuccaccgccgggaccuccgccugauggcgaacgccaucugcuccgccgugcccguggacugggucccgaccgggcggaccacguggagcauccacggcaagggggaguggaugaccaccgaggacaugcugaugguguggaaccgcguguggaucgaggagaacgaccacauggaggacaagacccccgucacgaaguggaccgacauccccuaccucggcaagcgggaggaccuguggugcggcucccugaucgggcaccgcccccggaccaccugggccgagaacaucaaggacacggugaacauggugcgccggaucaucggcgacgaggagaaguacauggacuaccucagcacccagguccgcuaccugggggaggagggcuccaccccgggggugcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 257 - RNA, 2347 nt, Artificial Sequence
  R4820/R4842 ZIKV (strain MR 766) Polyprotein(93-800) mRNA Design 1 GC
gggagaaagcuuaccaugcggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 258 - RNA, 2347 nt, Artificial Sequence
  ZIKV (strain MR 766) Polyprotein(93-800) mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucaccugcagcaagaagaugaccggcaaguccauccagcccgagaaccuggaguaccgcaucaugcugagcgugcacggcucccagcacagcgggaugaucggcuacgagaccgacgaggaccgcgccaaggucgaggugacgcccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggccgccucuucuccgggcaccugaagugccggcugaagauggacaagcuccgccugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcggcugaucacggccaacccggugaucaccgagagcaccgagaacuccaagaugaugcucgagcuggacccgcccuucggcgacagcuacaucgugaucggggucggcgacaagaagaucacccaccacuggcaccgcuccgggagcacgaucggcaaggccuucgaggcgaccgugcggggcgccaagcgcauggccgugcugggggacaccgccugggacuucggcagcgucgggggcguguucaacucccuggggaagggcauccaccagaucuucggcgccgcguucaagagccucuucgggggcauguccugguucagccagauccugaucgggacccugcucguguggcugggccugaacacgaagaacggguccaucagccucaccugccuggcccugggcggcgucaugaucuuccucuccaccgccgugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 259 - RNA, 1564 nt, Artificial Sequence
  ZIKV (strain MR 766) Polyprotein(273-719) mRNA Design 1 GC
gggagaaagcuuaccaugucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 260 - RNA, 1564 nt, Artificial Sequence
  ZIKV (strain MR 766) Polyprotein(273-719) mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgaggaccgggccaagguggaggugacccccaacuccccgcgcgccgaggccacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcuguucagcgggcaccugaagugccgccucaagauggacaagcugcggcugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcgccucaucacggccaacccggucaucaccgaguccaccgagaacagcaagaugaugcuggagcuggacccgcccuucggcgacuccuacaucgugaucggggugggcgacaagaagaucacccaccacuggcaccggagcggguccacgaucggcaaggccuucgaggccaccguccgcggcgccaagcggauggcggugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 261 - RNA, 2359 nt, Artificial Sequence
  R4805/R4835 ZIKV (strain ZikaSPH2015) Polyprotein(93-804) mRNA Design 1 optimized
gggagaaagcuuaccaugcggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacaccaagaacggcagcaucucccugaugugccuggcucugggaggcgugcugaucuuccugagcacagccgugucugccgacgugggcugcagcguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 262 - RNA, 1576 nt, Artificial Sequence
  ZIKV (strain ZikaSPH2015) Polyprotein(273-723) mRNA Design 1 optimized
gggagaaagcuuaccaugucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 263 - RNA, 2359 nt, Artificial Sequence
  R4817/R4839 ZIKV (isolate Z1106033) Polyprotein(93-804) mRNA Design 1 optimized
gggagaaagcuuaccaugcggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaccugugacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacgccaagaacggcagcaucucccugaugugccuggcucugggaggcgugcugaucuuccugagcacagccgugucugccgacgugggcugcagcguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 264 - RNA, 1576 nt, Artificial Sequence
  ZIKV (isolate Z1106033) Polyprotein(273-723) mRNA Design 1 optimized
gggagaaagcuuaccaugucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 265 - RNA, 2347 nt, Artificial Sequence
  R4821/R4843 ZIKV (strain MR 766) Polyprotein(93-800) mRNA Design 1 optimized
gggagaaagcuuaccaugcggaucaucaacgcccggaaagagcggaagcggagaggcgccgauaccagcaucggcaucaucggccugcugcugaccacagccauggccgccgagaucaccagaagaggcagcgccuacuacauguaccuggacagaagcgacgccggcaaggccaucagcuuugccacaacccugggcgugaacaagugccacgugcagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaggccagacggucuagaagggccgugacacugccuagccacagcacccggaagcugcagaccagaagccagaccuggcuggaaagcagagaguacaccaagcaccugaucaagguggaaaacuggaucuuccggaaccccggcuucgcccugguggccguggcuauugcuuggcugcugggcagcuccaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucugugggcggcguguucaacucccugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggcggagugaugaucuuccugagcaccgccguguccgccgaugugggcuguagcguggacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 266 - RNA, 1564 nt, Artificial Sequence
  ZIKV (strain MR 766) Polyprotein(273-719) mRNA Design 1 optimized
gggagaaagcuuaccaugucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 267 - RNA, 2359 nt, Artificial Sequence
  R4806/R4836 ZIKV (strain ZikaSPH2015) Polyprotein(93-804) mRNA Design 1 optimized
gggagaaagcuuaccaugcggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacaccaagaacggcagcauuagccugaugugccuggcccugggcggcgugcugaucuuccugagcaccgccguguccgccgacgugggcugcagcguggacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 268 - RNA, 1576 nt, Artificial Sequence
  ZIKV (strain ZikaSPH2015) Polyprotein(273-723) mRNA Design 1 optimized
gggagaaagcuuaccaugagccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 269 - RNA, 2359 nt, Artificial Sequence
  R4818/R4840 ZIKV (isolate Z1106033) Polyprotein(93-804) mRNA Design 1 optimized
gggagaaagcuuaccaugcggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaccugugacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccguguccgccgacgugggcugcagcguggacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 270 - RNA, 1576 nt, Artificial Sequence
  ZIKV (isolate Z1106033) Polyprotein(273-723) mRNA Design 1 optimized
gggagaaagcuuaccaugagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 271 - RNA, 2347 nt, Artificial Sequence
  R4822/R4844 ZIKV (strain MR 766) Polyprotein(93-800) mRNA Design 1 optimized
gggagaaagcuuaccaugcggaucaucaacgcccggaaagagcggaagcggagaggcgccgacaccagcaucggcaucaucggccugcugcugaccaccgccauggccgccgagaucaccagacggggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugaucaagguggaaaacuggaucuuccggaaccccggcuucgcccugguggccguggcuauugccuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcuccgugggcggcguguucaacagccugggcaagggcauccaccagaucuucggagccgccuucaagagccuguucggcggcaugagcugguucagccagauccugaucggcacccugcuggucuggcugggccugaacaccaagaacggcagcaucagccugaccugccuggcccugggcggagugaugaucuuccugagcaccgccgugucugccgacgugggcugcagcguggacuucuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 272 - RNA, 1564 nt, Artificial Sequence
  ZIKV (strain MR 766) Polyprotein(273-719) mRNA Design 1 optimized
gggagaaagcuuaccaugagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 273 - RNA, 10489 nt, Artificial Sequence
  ZIKV (strain ZikaSPH2015) complete polyprotein mRNA Design 1 optimized
gggagaaagcuuaccaugaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgacuacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaugggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugauggccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 274 - RNA, 2359 nt, Artificial Sequence
  ZIKV (strain ZikaSPH2015) Polyprotein(93-804) mRNA Design 1 optimized
gggagaaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 275 - RNA, 2359 nt, Artificial Sequence
  ZIKV (strain ZikaSPH2015) Polyprotein(93-804) mRNA Design 1 optimized
gggagaaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 276 - RNA, 1576 nt, Artificial Sequence
  ZIKV (strain ZikaSPH2015) Polyprotein(273-723) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 277 - RNA, 1576 nt, Artificial Sequence
  ZIKV (strain ZikaSPH2015) Polyprotein(273-723) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 278 - RNA, 10489 nt, Artificial Sequence
  ZIKV (isolate Z1106033) complete polyprotein mRNA Design 1 optimized
gggagaaagcuuaccaugaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaucggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 279 - RNA, 2359 nt, Artificial Sequence
  ZIKV (isolate Z1106033) Polyprotein(93-804) mRNA Design 1 optimized
gggagaaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 280 - RNA, 2359 nt, Artificial Sequence
  ZIKV (isolate Z1106033) Polyprotein(93-804) mRNA Design 1 optimized
gggagaaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 281 - RNA, 1576 nt, Artificial Sequence
  ZIKV (isolate Z1106033) Polyprotein(273-723) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 282 - RNA, 1576 nt, Artificial Sequence
  ZIKV (isolate Z1106033) Polyprotein273-719) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 283 - RNA, 10477 nt, Artificial Sequence
  ZIKV (strain MR 766) complete polyprotein mRNA Design 1 optimized
gggagaaagcuuaccaugaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaugagcaccagcauggccgugcugguggugaugauccugggcggcuucagcaugagcgaccuggccaagcuggugauccugaugggcgccaccuucgccgagaugaacaccggcggcgacguggcccaccuggcccugguggccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccauggccgugccccgcaccgacaacaucgcccugcccauccuggccgcccugaccccccuggcccgcggcacccugcugguggccuggcgcgccggccuggccaccugcggcggcaucaugcugcugagccugaagggcaagggcagcgugaagaagaaccugcccuucgugauggcccugggccugaccgccgugcgcgugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggaggacggcccccccaugcgcgagaucauccugaagguggugcugauggccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcgccgcccugcgcagcggcgagggccgccuggaccccuacuggggcgacgugaagcaggaccuggugagcuacugcggccccuggaagcuggacgccgccugggacggccugagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggcaagcgcgaggaggagacccccguggagugcuucgagcccagcaugcugaagaagaagcagcugaccgugcuggaccugcaccccggcgccggcaagacccgccgcgugcugcccgagaucgugcgcgaggccaucaagaagcgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccugaacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagaaccaggagugggacuucgugaucaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguacauguacggcggcggcugcgccgagaccgacgagggccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggaccaaguacggcgagaagcgcgugcugaagccccgcuggauggacgcccgcgugugcagcgaccacgccgcccugaagagcuucaaggaguucgccgccggcaagcgcggcgccgcccugggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagaacgacaucgcccaccugaugggccgccgcgaggagggcgccaccaugggcuucagcauggacaucgaccugcgccccgccagcgccugggccaucuacgccgcccugaccacccugaucacccccgccgugcagcacgccgugaccaccagcuacaacaacuacagccugauggccauggccacccaggccggcgugcuguucggcaugggcaagggcaugcccuucaugcacggcgaccugggcgugccccugcugaugaugggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccaucagcagcgccgugcugcugcgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagauccgcuggcuggaggagcgcggcuaccugcagcccuacggcaaggugguggaccugggcugcggccgcggcggcuggagcuacuacgccgccaccauccgcaaggugcaggaggugcgcggcuacaccaagggcggccccggccacgaggagcccaugcuggugcagagcuacggcuggaacaucgugcgccugaagagcggcguggacguguuccacauggccgccgagcccugcgacacccugcugugcgacaucggcgagagcagcagcagccccgagguggaggagacccgcacccugcgcgugcugagcauggugggcgacuggcuggagaagcgccccggcgccuucugcaucaaggugcugugccccuacaccagcaccaugauggagaccauggagcgccugcagcgccgccacggcggcggccuggugcgcgugccccugugccgcaacagcacccacgagauguacugggugagcggcgccaagagcaacaucaucaagagcgugagcaccaccagccagcugcugcugggccgcauggacggcccccgccgccccgugaaguacgaggaggacgugaaccugggcagcggcacccgcgccguggccagcugcgccgaggcccccaacaugaagaucaucggccgccgcaucgagcgcauccgcaacgagcacgccgagaccugguuccuggacgagaaccaccccuaccgcaccugggccuaccacggcagcuacgaggcccccacccagggcagcgccagcagccuggugaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugaacaucgugagcagcuggcuguggaaggagcugggcaagcgcaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggaccgcgagcgcgagcaccaccugcgcggcgagugccacagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacauccuggaggagaugaaccgcgcccccggcggcaagauguacgccgacgacaccgccggcugggacacccgcaucagcaaguucgaccuggagaacgaggcccugaucaccaaccagauggaggagggccaccgcacccuggcccuggccgugaucaaguacaccuaccagaacaagguggugaaggugcugcgccccgccgagggcggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgcaagcccgagaaggugacccgcuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcuggagcaacugggaggaggugcccuucugcagccaccacuucaacaagcuguaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcgccgugcccguggacugggugcccaccggccgcaccaccuggagcauccacggcaagggcgaguggaugaccaccgaggacaugcugaugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaaggacaccgugaacauggugcgccgcaucaucggcgacgaggagaaguacauggacuaccugagcacccaggugcgcuaccugggcgaggagggcagcacccccggcgugcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 284 - RNA, 2347 nt, Artificial Sequence
  ZIKV (strain MR 766) Polyprotein(93-800) mRNA Design 1 optimized
gggagaaagcuuaccaugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 285 - RNA, 2347 nt, Artificial Sequence
  ZIKV (strain MR 766) Polyprotein(93-800) mRNA Design 1 optimized
gggagaaagcuuaccaugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 286 - RNA, 1564 nt, Artificial Sequence
  ZIKV (strain MR 766) Polyprotein(273-719) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 287 - RNA, 1564 nt, Artificial Sequence
  ZIKV (strain MR 766) Polyprotein(273-719) mRNA Design 1 optimized
gggagaaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 288 - RNA, 10654 nt, Artificial Sequence
  ZIKV (strain ZikaSPH2015) complete polyprotein mRNA Design 2 wild type
ggggcgcugccuacggagguggcagccaucuccuucucggcaucaagcuuaccaugaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaucacuucucccuuggagugcuugugauucugcucauggugcaggaagggcugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacgugguggggcugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccaauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaagcccuuagagggcuuccagugcguuauaugacaacagcagucaaugucacccacucuggaacagaaaucgucgacuuaaugugccaugccaccuucacuucacgucuacuacagccaaucagaguccccaacuauaaucuguauauuauggaugaggcccacuucacagaucccucaaguauagcagcaagaggauacauuucaacaaggguugagaugggcgaggcggcugccaucuucaugaccgccacgccaccaggaacccgugacgcauuuccggacuccaacucaccaauuauggacaccgaaguggaagucccagagagagccuggagcucaggcuuugauugggugacggauuauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagagguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuuuuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccaugggauucucaauggacauugaccugcggccagccucagcuugggccaucuaugcugccuugacaacuuucauuaccccagccguccaacaugcagugaccacuucauacaacaacuacuccuuaauggcgauggccacgcaagcuggaguguuguuugguaugggcaaagggaugccauucuacgcaugggacuuuggagucccgcugcuaaugauagguugcuacucacaauuaacgccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauggcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaagguacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucgcauaccaggaggaaggauguaugcagaugacacugcuggcugggacacccgcaucagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguccuagagaugcaagacuuguggcugcugcggaggucagagaaagugaccaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 289 - RNA, 2524 nt, Artificial Sequence
  ZIKV (strain ZikaSPH2015) Polyprotein(93-804) mRNA Design 2 wild type
ggggcgcugccuacggagguggcagccaucuccuucucggcaucaagcuuaccaugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 290 - RNA, 2524 nt, Artificial Sequence
  R4797 ZIKV (strain ZikaSPH2015) Polyprotein(93-804) mRNA Design 2 wild type
ggggcgcugccuacggagguggcagccaucuccuucucggcaucaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 291 - RNA, 1741 nt, Artificial Sequence
  ZIKV (strain ZikaSPH2015) Polyprotein(273-723) mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 292 - RNA, 10654 nt, Artificial Sequence
  ZIKV (isolate Z1106033) complete polyprotein mRNA Design 2 wild type
ggggcgcugccuacggagguggcagccaucuccuucucggcaucaagcuuaccaugaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugcaggaucaacugaucacauggaccacuucucccuuggagugcuugugauucugcucauggugcaggaaggguugaagaagagaaugaccacaaagaucaucauaagcacaucaauggcagugcugguagcuaugauccugggaggauuuucaaugagugaccuggcuaagcuugcaauuuugaugggugccaccuucgcggaaaugaacacuggaggagauguagcucaucuggcgcugauagcggcauucaaagucagaccagcguugcugguaucuuucaucuucagagcuaauuggacaccccgugaaagcaugcugcuggccuuggccucgugucuuuugcaaacugcgaucuccgccuuggaaggcgaccugaugguucucaucaaugguuuugcuuuggccugguuggcaauacgagcgaugguuguuccacgcacugauaacaucaccuuggcaauccuggcugcucugacaccacuggcccggggcacacugcuuguggcguggagagcaggccuugcuacuugcgggggguuuaugcuccucucucugaagggaaaaggcagugugaagaagaacuuaccauuugucauggcccugggacuaaccgcugugaggcuggucgaccccaucaacguggugggacugcuguugcucacaaggagugggaagcggagcuggcccccuagcgaaguacucacagcuguuggccugauaugcgcauuggcuggaggguucgccaaggcagauauagagauggcugggcccauggccgcggucggucugcuaauugucaguuacguggucucaggaaagaguguggacauguacauugaaagagcaggugacaucacaugggaaaaagaugcggaagucacuggaaacaguccccggcucgauguggcgcuagaugagaguggugauuucucccugguggaggaugacgguccccccaugagagagaucauacucaaggugguccugaugaccaucuguggcaugaacccaauagccauacccuuugcagcuggagcgugguacguauacgugaagacuggaaaaaggaguggugcucuaugggaugugccugcucccaaggaaguaaaaaagggggagaccacagauggaguguacagaguaaugacucguagacugcuagguucaacacaaguuggagugggaguuaugcaagagggggucuuucacacuauguggcacgucacaaaaggauccgcgcugagaagcggugaagggagacuugauccauacuggggagaugucaagcaggaucuggugucauacugugguccauggaagcuagaugccgccugggacgggcacagcgaggugcagcucuuggccgugccccccggagagagagcgaggaacauccagacucugcccggaauauuuaagacaaaggauggggacauuggagcgguugcgcuggauuacccagcaggaacuucaggaucuccuauccuagacaagugugggagagugauaggacuuuauggcaauggggucgugaucaaaaaugggaguuauguuagugccaucacccaagggaggagggaggaagagacuccuguugagugcuucgagccuucgaugcugaagaagaagcagcuaacugucuuagacuugcauccuggagcugggaaaaccaggagaguucuuccugaaauaguccgugaagccauaaaaacaagacuccguacugugaucuuagcuccaaccaggguugucgcugcugaaauggaggaggcccuuagagggcuuccagugcguuauaugacaacagcagucaaugucacccacucuggaacagaaaucgucgacuuaaugugccaugccaccuucacuucgcgucuacuacagccaaucagaguccccaacuauaaucuguauauuauggaugaggcccacuucacagaucccucaaguauagcagcaagaggauacauuucaacaaggguugagaugggcgaggcggccgccaucuucaugaccgccacgccaccaggaacccgugacgcauuuccggacuccaacucaccaauuauggacaccgaaguggaagucccagagagagccuggagcucaggcuuugauugggugacggaucauucuggaaaaacaguuugguuuguuccaagcgugaggaacggcaaugagaucgcagcuugucugacaaaggcuggaaaacgggucauacagcucagcagaaagacuuuugagacagaguuccagaaaacaaaacaucaagagugggacuuugucgugacaacugacauuucagagaugggcgccaacuuuaaagcugaccgugucauagauuccaggagaugccuaaagccggucauacuugauggcgagagagucauucuggcuggacccaugccugucacacaugccagcgcugcccagaggagggggcgcauaggcaggaaucccaacaaaccuggagaugaguaucuguauggaggugggugcgcagagacugacgaagaccaugcacacuggcuugaagcaagaaugcuccuugacaauauuuaccuccaagauggccucauagccucgcucuaucgaccugaggccgacaaaguagcagccauugagggagaguucaagcuuaggacggagcaaaggaagaccuuuguggaacucaugaaaagaggagaucuuccuguuuggcuggccuaucagguugcaucugccggaauaaccuacacagauagaagauggugcuuugauggcacgaccaacaacaccauaauggaagacagugugccggcagaaguguggaccagacacggagagaaaagagugcucaaaccgagguggauggacgccagaguuuguucagaucaugcggcccugaagucauucaaggaguuugccgcugggaaaagaggagcggcuuuuggagugauggaagcccugggaacacugccaggacacaugacagagagauuccaggaagccauugacaaccucgcugugcucaugcgggcagagacuggaagcaggccuuacaaagccgcggcggcccaauugccggagacccuagagaccauuaugcuuuugggguugcugggaacagucucgcugggaaucuucuucgucuugaugaggaacaagggcauagggaagaugggcuuuggaauggugacucuuggggccagcgcauggcucauguggcucucggaaauugagccagccagaauugcauguguccucauuguuguguuccuauugcugguggugcucauaccugagccagaaaagcaaagaucuccccaggacaaccaaauggcaaucaucaucaugguagcaguaggucuucugggcuugauuaccgccaaugaacucggaugguuggagagaacaaagagugaccuaagccaucuaaugggaaggagagaggagggggcaaccauaggauucucaauggacauugaccugcggccagccucagcuugggccaucuaugcugccuugacaacuuucauuaccccagccguccaacaugcagugaccaccucauacaacaacuacuccuuaauggcgauggccacgcaagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccauacugucgcggaccgccuggggguggggggaggcuggggcccugaucacagccgcaacuuccacuuugugggaaggcucuccgaacaaguacuggaacuccucuacagccacuucacuguguaacauuuuuaggggaaguuacuuggcuggagcuucucuaaucuacacaguaacaagaaacgcuggcuuggucaagagacguggggguggaacaggagagacccugggagagaaauggaaggcccgcuugaaccagaugucggcccuggaguucuacuccuacaaaaagucaggcaucaccgaggugugcagagaagaggcccgccgcgcccucaaggacgguguggcaacgggaggccaugcugugucccgaggaagugcaaagcugagaugguugguggagcggggauaccugcagcccuauggaaaggucauugaucuuggauguggcagagggggcuggaguuacuacgccgccaccauccgcaaaguucaagaagugaaaggauacacaaaaggaggcccuggucaugaagaacccguguuggugcaaagcuauggguggaacauaguccgucuuaagagugggguggacgucuuucauauggcggcugagccgugugacacguugcugugugacauaggugagucaucaucuaguccugaaguggaagaagcacggacgcucagaguccucuccauggugggggauuggcuugaaaaaagaccaggagccuuuuguauaaaaguguugugcccauacaccagcacuaugauggaaacccuggagcgacugcagcguagguaugggggaggacuggucagagugccacucucccgcaacucuacacaugagauguacugggucucuggagcgaaaagcaacaccauaaaaaguguguccaccacgagccagcuccucuuggggcgcauggacgggccuaggaggccagugaaauaugaggaggaugugaaucucggcucuggcacgcgggcugugguaagcugcgcugaagcucccaacaugaagaucauugguaaccgcauugaaaggauccgcagugagcacgcggaaacgugguucuuugacgagaaccacccauauaggacaugggcuuaccauggaagcuaugaggcccccacacaagggucagcguccucucuaauaaacgggguugucaggcuccugucaaaacccugggauguggugacuggagucacaggaauagccaugaccgacaccacaccguauggucagcaaagaguuuucaaggaaaaaguggacacuagggugccagacccccaagaaggcacucgucagguuaugagcauggucucuuccugguuguggaaagagcuaggcaaacacaaacggccacgagucuguaccaaagaagaguucaucaacaagguucguagcaaugcagcauuaggggcaauauuugaagaggaaaaagaguggaagacugcaguggaagcugugaacgauccaagguucugggcucuaguggacaaggaaagagagcaccaccugagaggagagugccagaguuguguguacaacaugaugggaaaaagagaaaagaaacaaggggaauuuggaaaggccaagggcagccgcgccaucugguauauguggcuaggggcuagauuucuagaguucgaagcccuuggauucuugaacgaggaucacuggauggggagagagaacucaggaggugguguugaagggcugggauuacaaagacucggauauguccuagaagagaugagucguauaccaggaggaaggauguaugcagaugacacugcuggcugggacacccgcauuagcagguuugaucuggagaaugaagcucuaaucaccaaccaaauggagaaagggcacagggccuuggcauuggccauaaucaaguacacauaccaaaacaaagugguaaagguccuuagaccagcugaaaaagggaaaacaguuauggacauuauuucgagacaagaccaaagggggagcggacaaguugucacuuacgcucuuaacacauuuaccaaccuaguggugcaacucauucggaauauggaggcugaggaaguucuagagaugcaagacuuguggcugcugcggaggucagagaaagugacuaacugguugcagagcaacggaugggauaggcucaaacgaauggcagucaguggagaugauugcguugugaagccaauugaugauagguuugcacaugcccucagguucuugaaugauaugggaaaaguuaggaaggacacacaagaguggaaacccucaacuggaugggacaacugggaagaaguuccguuuugcucccaccacuucaacaagcuccaucucaaggacgggagguccauugugguucccugccgccaccaagaugaacugauuggccgggcccgcgucucuccaggggcgggauggagcauccgggagacugcuugccuagcaaaaucauaugcgcaaauguggcagcuccuuuauuuccacagaagggaccuccgacugauggccaaugccauuuguucaucugugccaguugacuggguuccaacugggagaacuaccuggucaauccauggaaagggagaauggaugaccacugaagacaugcuugugguguggaacagaguguggauugaggagaacgaccacauggaagacaagaccccaguuacgaaauggacagacauucccuauuugggaaaaagggaagacuugugguguggaucucucauagggcacagaccgcgcaccaccugggcugagaacauuaaaaacacagucaacauggugcgcaggaucauaggugaugaagaaaaguacauggacuaccuauccacccaaguucgcuacuugggugaagaagggucuacaccuggagugcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 293 - RNA, 2524 nt, Artificial Sequence
  ZIKV (isolate Z1106033) Polyprotein(93-804) mRNA Design 2 wild type
ggggcgcugccuacggagguggcagccaucuccuucucggcaucaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 294 - RNA, 2524 nt, Artificial Sequence
  ZIKV (isolate Z1106033) Polyprotein(93-804) mRNA Design 2 wild type
ggggcgcugccuacggagguggcagccaucuccuucucggcaucaagcuuaccaugagaauaaucaaugcuaggaaggagaagaagagacgaggcgcagauacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 295 - RNA, 1741 nt, Artificial Sequence
  ZIKV (isolate Z1106033) Polyprotein(273-723) mRNA Design 2 wild type
ggggcgcugccuacggagguggcagccaucuccuucucggcaucaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 296 - RNA, 10642 nt, Artificial Sequence
  ZIKV (strain MR 766) complete polyprotein mRNA Design 2 wild type
ggggcgcugccuacggagguggcagccaucuccuucucggcaucaagcuuaccaugaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcggggucaaccgaucauauggaccacuucucucuuggagugcuugugauucuacucauggugcaggagggguugaagaagagaaugaccacaaagaucaucaugagcacaucaauggcagugcugguagucaugaucuugggaggauuuucaaugagugaccuggccaagcuugugauccugaugggugcuacuuucgcagaaaugaacacuggaggagauguagcucacuuggcauugguagcggcauuuaaagucagaccagccuugcuggucuccuucauuuucagagccaauuggacaccccgugagagcaugcugcuagcccuggcuucgugucuucugcaaacugcgaucucugcucuugaaggugacuugaugguccucauuaauggauuugcuuuggccugguuggcaauucgagcaauggccgugccacgcacugacaacaucgcucuaccaaucuuggcugcucuaacaccacuagcucgaggcacacugcucguggcauggagagcgggccuggcuacuuguggagggaucaugcuccucucccugaaagggaaagguagugugaagaagaaccugccauuugucauggcccugggauugacagcugugaggguaguagacccuauuaaugugguaggacuacuguuacucacaaggagugggaagcggagcuggcccccuagugaaguucucacagccguuggccugauaugugcacuggccggaggguuugccaaggcagacauugagauggcuggacccauggcugcaguaggcuugcuaauugucagcuauguggucucgggaaagaguguggacauguacauugaaagagcaggugacaucacaugggaaaaggacgcggaagucacuggaaacaguccucggcuugacguggcacuggaugagaguggugacuucuccuugguagaggaagaugguccacccaugagagagaucauacucaaggugguccugauggccaucuguggcaugaacccaauagcuauaccuuuugcugcaggagcgugguauguguaugugaagacugggaaaaggaguggcgcccucugggacgugccugcucccaaagaagugaagaaaggagagaccacagauggaguguacagagugaugacucgcagacugcuagguucaacacagguuggagugggagucaugcaagagggagucuuccacaccauguggcacguuacaaaaggagccgcacugaggagcggugagggaagacuugauccauacuggggggaugucaagcaggacuuggugucauacugugggccuuggaaguuggaugcagcuugggauggacucagcgagguacagcuuuuggccguaccucccggagagagggccagaaacauucagacccugccuggaauauucaagacaaaggacggggacaucggagcaguugcucuggacuacccugcagggaccucaggaucuccgauccuagacaaauguggaagagugauaggacucuauggcaaugggguugugaucaagaauggaagcuauguuagugcuauaacccagggaaagagggaggaggagacuccgguugaauguuucgaacccucgaugcugaagaagaagcagcuaacugucuuggaucugcauccaggagccggaaaaaccaggagaguucuuccugaaauaguccgugaagccauaaaaaagagacuccggacagugaucuuggcaccaacuaggguugucgcugcugagauggaggaggccuugagaggacuuccggugcguuacaugacaacagcagucaacgucacccauucugggacagaaaucguugauuugaugugccaugccacuuucacuucacgcuuacuacaacccaucagagucccuaauuacaaucucaacaucauggaugaagcccacuucacagaccccucaaguauagcugcaagaggauacauaucaacaaggguugaaaugggcgaggcggcugccauuuuuaugacugccacaccaccaggaacccgugaugcguuuccugacucuaacucaccaaucauggacacagaaguggaagucccagagagagccuggagcucaggcuuugauugggugacagaccauucugggaaaacaguuugguucguuccaagcgugagaaacggaaaugaaaucgcagccugucugacaaaggcuggaaagcgggucauacagcucagcaggaagacuuuugagacagaauuucagaaaacaaaaaaucaagagugggacuuugucauaacaacugacaucucagagaugggcgccaacuucaaggcugaccgggucauagacucuaggagaugccuaaaaccagucauacuugauggugagagagucaucuuggcugggcccaugccugucacgcaugcuagugcugcucagaggagaggacguauaggcaggaacccuaacaaaccuggagaugaguacauguauggaggugggugugcagagacugaugaaggccaugcacacuggcuugaagcaagaaugcuucuugacaacaucuaccuccaggauggccucauagccucgcucuaucggccugaggccgauaagguagccgccauugagggagaguuuaagcugaggacagagcaaaggaagaccuucguggaacucaugaagagaggagaccuucccgucuggcuagccuaucagguugcaucugccggaauaacuuacacagacagaagauggugcuuugauggcacaaccaacaacaccauaauggaagacaguguaccagcagagguuuggacaaaguauggagagaagagagugcucaaaccgagauggauggaugcuagggucuguucagaccaugcggcccugaagucguucaaagaauucgccgcuggaaaaagaggagcggcuuugggaguaauggaggcccugggaacacugccaggacacaugacagagagguuucaggaagccauugacaaccucgccgugcucaugcgagcagagacuggaagcaggccuuauaaggcagcggcagcccaacugccggagacccuagagaccauuaugcucuuagguuugcugggaacaguuucacuggggaucuucuucgucuugaugcggaauaagggcaucgggaagaugggcuuuggaaugguaacccuuggggccagugcauggcucauguggcuuucggaaauugaaccagccagaauugcauguguccucauuguuguguuuuuauuacugguggugcucauacccgagccagagaagcaaagaucuccccaagauaaccagauggcaauuaucaucaugguggcagugggccuucuagguuugauaacugcaaacgaacuuggauggcuggaaagaacaaaaaaugacauagcucaucuaaugggaaggagagaagaaggagcaaccaugggauucucaauggacauugaucugcggccagccuccgccugggcuaucuaugccgcauugacaacucucaucaccccagcuguccaacaugcgguaaccacuucauacaacaacuacuccuuaauggcgauggccacacaagcuggagugcuguuuggcaugggcaaagggaugccauuuaugcauggggaccuuggagucccgcugcuaaugauggguugcuauucacaauuaacaccccugacucugauaguagcuaucauucugcuuguggcgcacuacauguacuugaucccaggccuacaagcggcagcagcgcgugcugcccagaaaaggacagcagcuggcaucaugaagaaucccguuguggauggaauagugguaacugacauugacacaaugacaauagacccccagguggagaagaagaugggacaaguguuacucauagcaguagccaucuccagugcugugcugcugcggaccgccuggggauggggggaggcuggagcucugaucacagcagcgaccuccaccuugugggaaggcucuccaaacaaauacuggaacuccucuacagccaccucacugugcaacaucuucagaggaagcuaucuggcaggagcuucccuuaucuauacagugacgagaaacgcuggccugguuaagagacguggaggugggacgggagagacucugggagagaaguggaaagcucgucugaaucagaugucggcccuggaguucuacucuuauaaaaagucagguaucacugaaguguguagagaggaggcucgccgugcccucaaggauggaguggccacaggaggacaugccguaucccggggaagugcaaagaucagaugguuggaggagagaggauaucugcagcccuaugggaagguuguugaccucggauguggcagagggggcuggagcuauuaugccgccaccauccgcaaagugcaggaggugagaggauacacaaagggaggucccggucaugaagaacccaugcuggugcaaagcuauggguggaacauaguucgucucaagaguggaguggacgucuuccacauggcggcugagccgugugacacucugcugugugacauaggugagucaucaucuaguccugaaguggaagagacacgaacacucagagugcucucuauggugggggacuggcuugaaaaaagaccaggggccuucuguauaaaggugcugugcccauacaccagcacuaugauggaaaccauggagcgacugcaacguaggcaugggggaggauuagucagagugccauugugucgcaacuccacacaugagauguacugggucucuggggcaaagagcaacaucauaaaaaguguguccaccacaagucagcuccuccugggacgcauggauggccccaggaggccagugaaauaugaggaggaugugaaccucggcucggguacacgagcuguggcaagcugugcugaggcuccuaacaugaaaaucaucggcaggcgcauugagagaauccgcaaugaacaugcagaaacaugguuucuugaugaaaaccacccauacaggacaugggccuaccaugggagcuacgaagcccccacgcaaggaucagcgucuucccucgugaacgggguuguuagacuccugucaaagccuugggacguggugacuggaguuacaggaauagccaugacugacaccacaccauacggccaacaaagagucuucaaagaaaaaguggacaccagggugccagauccccaagaaggcacucgccagguaaugaacauagucucuuccuggcuguggaaggagcuggggaaacgcaagcggccacgcgucugcaccaaagaagaguuuaucaacaaggugcgcagcaaugcagcacugggagcaauauuugaagaggaaaaagaauggaagacggcuguggaagcugugaaugauccaagguuuugggcccuaguggauagggagagagaacaccaccugagaggagagugucacagcuguguguacaacaugaugggaaaaagagaaaagaagcaaggagaguucgggaaagcaaaagguagccgcgccaucugguacaugugguugggagccagauucuuggaguuugaagcccuuggauucuugaacgaggaccauuggaugggaagagaaaacucaggagguggagucgaaggguuaggauugcaaagacuuggauacauucuagaagaaaugaaucgggcaccaggaggaaagauguacgcagaugacacugcuggcugggacacccgcauuaguaaguuugaucuggagaaugaagcucugauuaccaaccaaauggaggaagggcacagaacucuggcguuggccgugauuaaauacacauaccaaaacaaaguggugaagguucucagaccagcugaaggaggaaaaacaguuauggacaucauuucaagacaagaccagagagggaguggacaaguugucacuuaugcucucaacacauucaccaacuugguggugcagcuuauccggaacauggaagcugaggaaguguuagagaugcaagacuuaugguuguugaggaagccagagaaagugaccagaugguugcagagcaauggaugggauagacucaaacgaauggcggucaguggagaugacugcguugugaagccaaucgaugauagguuugcacaugcccucagguucuugaaugacaugggaaaaguuaggaaagacacacaggaguggaaacccucgacuggauggagcaauugggaagaagucccguucugcucccaccacuucaacaagcuguaccucaaggaugggagauccauuguggucccuugccgccaccaagaugaacugauuggccgagcucgcgucucaccaggggcaggauggagcauccgggagacugccugucuugcaaaaucauaugcgcagauguggcagcuccuuuauuuccacagaagagaccuucgacugauggcuaaugccauuugcucggcugugccaguugacuggguaccaacugggagaaccaccuggucaauccauggaaagggagaauggaugaccacugaggacaugcucaugguguggaauagaguguggauugaggagaacgaccauauggaggacaagacuccuguaacaaaauggacagacauucccuaucuaggaaaaagggaggacuuaugguguggaucccuuauagggcacagaccccgcaccacuugggcugaaaacaucaaagacacagucaacauggugcgcaggaucauaggugaugaagaaaaguacauggacuaucuauccacccaaguccgcuacuugggugaggaaggguccacacccggaguguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 297 - RNA, 2512 nt, Artificial Sequence
  ZIKV (strain MR 766) Polyprotein(93-800) mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 298 - RNA, 2512 nt, Artificial Sequence
  ZIKV (strain MR 766) Polyprotein(93-800) mRNA Design 2 wild type
ggggcgcugccuacggagguggcagccaucuccuucucggcaucaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 299 - RNA, 1729 nt, Artificial Sequence
  ZIKV (strain MR 766) Polyprotein(273-719) mRNA Design 2 wild type
ggggcgcugccuacggagguggcagccaucuccuucucggcaucaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 300 - RNA, 1729 nt, Artificial Sequence
  ZIKV (strain MR 766) Polyprotein(273-719) mRNA Design 2 wild type
ggggcgcugccuacggagguggcagccaucuccuucucggcaucaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 301 - RNA, 10654 nt, Artificial Sequence
  ZIKV (strain ZikaSPH2015) complete polyprotein mRNA Design 2 GC
ggggcgcugccuacggagguggcagccaucuccuucucggcaucaagcuuaccaugaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcggggagcaccgaccacauggaccacuucagccugggcguccucgugauccugcugauggugcaggaggggcucaagaagcgcaugacgaccaagaucaucaucuccaccagcauggccguccugguggccaugauccugggcggguucuccaugagcgaccucgccaagcuggccauccugaugggcgcgaccuucgccgagaugaacaccggcggggacguggcccaccucgcccugaucgccgcguucaagguccgccccgcccugcucguguccuucaucuuccgggccaacuggacgccccgcgagagcaugcugcuggcccucgcguccugccugcugcagaccgccaucagcgcccucgagggcgaccugauggugcugaucaacggguucgcccucgccuggcuggcgauccgggccauggucgugccgcgcaccgacaacaucacccuggccauccucgccgcccugacgccccuggcgcggggcacccuccugguggccuggcgcgccgggcuggccacgugcggcggcuucaugcuccugucccugaaggggaagggcagcgucaagaagaaccuccccuucgugauggcccuggggcugaccgcggugcggcucgucgaccccaucaacguggugggccugcugcuccugacgcgcuccgggaagcggagcuggccgcccuccgagguccugaccgccgugggccucaucugcgcccuggccggcggguucgcgaaggccgacaucgagauggccggccccauggccgccguggggcugcucaucgucagcuacgugguguccggcaagagcgucgacauguacaucgagcgcgcgggggacaucaccugggagaaggacgccgaggugaccggcaacuccccgcggcuggacguggcccuggacgagagcggcgacuucucccucgucgaggacgacgggccgcccaugcgcgagaucauccugaagguggugcugaugacgaucugcggcaugaaccccaucgccaucccguucgccgcgggggccugguacgucuacgugaagaccggcaagcggagcggcgcccugugggacgugcccgcccccaaggaggucaagaagggggagaccaccgacggcguguaccgcgugaugacgcggcgccuccuggggagcacccaggucggcgugggggugaugcaggagggcgucuuccacaccauguggcacgugaccaagggcuccgcccugcggagcggggagggccgccucgaccccuacuggggcgacgugaagcaggaccuggucuccuacugcgggccguggaagcuggacgcggccugggacgggcacagcgaggugcagcuccuggccgugcccccgggcgagcgggcccgcaacauccagacgcugcccggcaucuucaagaccaaggacggggacaucggcgcggucgcccucgacuacccggccgggaccuccggcagccccauccuggacaagugcgggcgcgugaucggccuguacggcaacgggguggucaucaagaacggcuccuacgugagcgccaucacccaggggcggcgcgaggaggagacgcccgucgagugcuucgagcccuccaugcucaagaagaagcagcugaccgugcuggaccuccacccgggcgccgggaagacccggcgcgugcugcccgagaucguccgggaggcgaucaagacccgccugcggacggugauccucgcccccacccgcguggucgccgccgagauggaggaggcccugcggggccugcccgugcgcuacaugaccaccgcggugaacgucacgcacagcggcaccgagaucguggaccucaugugccacgccaccuucaccucccggcugcugcagccgauccgcgugcccaacuacaaccucuacaucauggacgaggcccacuucacggaccccagcuccaucgccgcccggggguacaucagcacccgcgucgagaugggcgaggcggccgccaucuucaugaccgccaccccgccggggacccgggacgccuuccccgacuccaacagccccaucauggacacggagguggaggugcccgagcgcgcgugguccagcggcuucgacugggucaccgacuacuccggcaagaccgugugguucgugccgagcguccggaacgggaacgagaucgccgccugccugaccaaggccggcaagcgcgugauccagcugagccggaagacguucgagaccgaguuccagaagaccaagcaccaggagugggacuucguggucaccacggacaucuccgagaugggggcgaacuucaaggccgaccgcgugaucgacagccggcgcugccucaagcccgugauccuggacggcgagcgcgucauccuggccgggcccaugcccgugacccacgccuccgccgcgcagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgccagccucuaccgccccgaggcggacaagguggccgccaucgagggcgaguucaagcugcggaccgagcagcgcaagacguucgucgagcugaugaagcggggcgaccucccgguguggcuggccuaccagguggccuccgcggggaucaccuacaccgaccgccgguggugcuucgacggcaccacgaacaacaccaucauggaggacagcguccccgccgagguguggacccgccacggggagaagcgggugcugaagccccgcuggauggacgcccgggucugcuccgaccacgccgcgcucaagagcuucaaggaguucgccgccggcaagcgcggggccgccuucggcgugauggaggcgcugggcacccugcccgggcacaugacggagcgguuccaggaggccaucgacaaccucgccgugcugaugcgcgccgagaccggcucccggccguacaaggccgcggccgcccagcugcccgagacccucgagaccaucaugcugcuggggcuccugggcacggucagccugggcaucuucuucgugcucaugcgcaacaaggggaucggcaagaugggguucggcauggugacccugggggccuccgccuggcugauguggcucagcgagaucgagcccgcgcgcaucgccugcguccugaucgugguguuccugcuccuggucgugcugauccccgagccggagaagcagcgguccccgcaggacaaccagauggccaucaucaucaugguggccgucggccuccugggccugaucaccgcgaacgagcucggguggcuggagcgcaccaagagcgaccugucccaccucaugggccggcgcgaggagggggccacgaugggcuucagcauggacaucgaccugcggcccgccuccgccugggccaucuacgcggcccugaccaccuucaucacccccgccgugcagcacgccgugacgaccagcuacaacaacuacucccucauggccauggcgacccaggccgggguccuguucggcaugggcaaggggaugccguucuacgccugggacuucggcgugccgcugcucaugaucgggugcuacagccagcugaccccgcugacgcucaucguggccaucauccugcuggucgcccacuacauguaccucauccccggccugcaggcggccgccgcccgcgccgcgcagaagcggaccgccgccgggaucaugaagaacccgguggucgacggcaucguggugaccgacaucgacaccaugacgaucgacccccaggucgagaagaagaugggccaggugcugcucauggccguggcggucagcuccgccauccugagccgcaccgccuggggguggggcgaggccggggcccugaucaccgcggccaccuccacccucugggagggcagccccaacaaguacuggaacuccagcacggccaccucccugugcaacaucuuccgggggagcuaccuggccggcgccucccucaucuacaccgugacccgcaacgcgggccuggugaagcggcgcgggggcgggacgggcgagacccugggcgagaaguggaaggcccggcucaaccagaugagcgcccuggaguucuacuccuacaagaagagcgggaucaccgaggucugccgcgaggaggcccggcgcgcccugaaggacggcguggcgaccgggggccacgccgugucccgggggagcgccaagcuccgcuggcuggucgagcggggcuaccugcagcccuacggcaaggugaucgaccuggggugcggccgcgggggcugguccuacuacgccgcgacgauccggaaggugcaggaggucaagggguacaccaagggcggcccggggcacgaggagcccgugcucgugcagagcuacggcuggaacaucguccgccugaaguccgggguggacguguuccacauggccgccgagcccugcgacacccugcucugcgacaucggcgagagcuccagcagccccgaggucgaggaggcccgcacccugcgggugcuguccauggugggggacuggcucgagaagcgcccgggcgccuucugcaucaagguccugugccccuacacgagcaccaugauggagacccuggagcggcuccagcgccgguacggcgggggccuggugcgcgugccccugucccggaacagcacccacgagauguacugggucuccggggcgaagagcaacacgaucaaguccgugagcaccaccucccagcuccugcugggccgcauggacggcccccggcgcccggugaaguacgaggaggacgucaaccucgggagcggcacccgggccgugguguccugcgccgaggcccccaacaugaagaucaucgggaaccgcaucgagcggauccgcagcgagcacgccgagacgugguucuucgacgagaaccaccccuaccggaccugggcguaccacggcuccuacgaggccccgacccaggggagcgccuccagccugaucaacggcgucgugcgccugcucuccaagcccugggacguggucaccggcgugacggggaucgccaugaccgacaccacccccuacggccagcagcggguguucaaggagaaggucgacacgcgcgugcccgacccgcaggaggggacccgccaggugaugagcauggucagcuccuggcuguggaaggagcugggcaagcacaagcgcccccgcgugugcaccaaggaggaguucaucaacaaggugcggagcaacgccgcgcucggggccaucuucgaggaggagaaggaguggaagaccgccgucgaggccgugaacgacccccgcuucugggcccugguggacaaggagcgggagcaccaccuccgcggcgagugccaguccugcgucuacaacaugaugggcaagcgggagaagaagcagggggaguucggcaaggcgaaggggagccgcgccaucugguacauguggcucggcgcccgguuccuggaguucgaggcccugggguuccucaacgaggaccacuggaugggccgcgagaacuccggcgggggcguggaggggcugggccugcagcggcucggguacgugcuggaggagaugagccgcauccccggcggccggauguacgcggacgacacggccgggugggacacccgcaucucccgguucgaccuggagaacgaggcccucaucaccaaccagauggagaagggccaccgcgcccuggcccuggcgaucaucaaguacaccuaccagaacaaggucgugaagguccuccggccggccgagaaggggaagacggugauggacaucaucagccgccaggaccagcggggcuccggccagguggucaccuacgcccugaacaccuucaccaaccugguggugcagcucauccgcaacauggaggccgaggagguccuggagaugcaggaccuguggcuccugcggcgcagcgagaaggugaccaacuggcugcaguccaacgggugggaccggcucaagcgcauggccgugagcggcgacgacugcgucgugaagcccaucgacgaccgcuucgcgcacgcccugcgguuccugaacgacauggggaaggugcgcaaggacacgcaggaguggaagcccuccaccggcugggacaacugggaggagguccccuucugcagccaccacuucaacaagcuccaccugaaggacgggcgguccaucguggugccgugccgccaccaggacgagcugaucggccgggcccgcgucagccccggcgccgggugguccauccgggagaccgccugccucgcgaagagcuacgcccagauguggcagcugcuguacuuccaccgccgggaccuccgccugauggccaacgccaucugcuccagcgugcccguggacuggguccccaccggccggacgaccuggagcauccacgggaagggcgaguggaugaccaccgaggacaugcuggugguguggaaccgcgucuggaucgaggagaacgaccacauggaggacaagacgccggugaccaaguggaccgacauccccuaccucgggaagcgggaggaccuguggugcggcucccugaucggccaccgcccccggaccacgugggcggagaacaucaagaacaccgugaacaugguccgccggaucaucggggacgaggagaaguacauggacuaccucagcacccaggugcgcuaccugggcgaggagggguccacccccggcgugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 302 - RNA, 2524 nt, Artificial Sequence
  R5050/R5051/R4798 ZIKV (strain ZikaSPH2015) Polyprotein(93-804) mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 303 - RNA, 2524 nt, Artificial Sequence
  ZIKV (strain ZikaSPH2015) Polyprotein(93-804) mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacaucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcaccccgcacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcacggcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgccguucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccugaacucccucgggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 304 - RNA, 1741 nt, Artificial Sequence
  R5054/R5055 ZIKV (strain ZikaSPH2015) Polyprotein(273-723) mRNA Design 2 GC
ggggcgcugccuacggagguggcagccaucuccuucucggcaucaagcuuaccaugagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 305 - RNA, 1741 nt, Artificial Sequence
  ZIKV (strain ZikaSPH2015) Polyprotein(273-723) mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacaucgugcuggagcacggcgggugcgugaccgucauggcgcaggacaagccgacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcucuucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaacccggugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 306 - RNA, 10654 nt, Artificial Sequence
  ZIKV (isolate Z1106033) complete polyprotein mRNA Design 2 GC
ggggcgcugccuacggagguggcagccaucuccuucucggcaucaagcuuaccaugaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgccgggagcaccgaccacauggaccacuucagccugggcgugcucgugauccugcugaugguccaggaggggcucaagaagcgcaugacgaccaagaucaucaucuccaccagcauggccgugcugguggccaugauccugggcggguucuccaugagcgaccucgccaagcuggcgauccugaugggcgccaccuucgccgagaugaacaccggcggggacgucgcccaccucgcccugaucgcggccuucaaggugcgccccgcccugcucguguccuucaucuuccgggccaacuggacgccccgcgagagcaugcugcuggcgcucgccuccugccugcugcagaccgccaucagcgcccucgagggcgaccugaugguccugaucaacggguucgcccucgcguggcuggccauccgggccaugguggugccgcgcaccgacaacaucacccuggccauccucgccgcgcugacgccccuggcccggggcacccuccuggucgccuggcgcgccgggcuggccacgugcggcggcuucaugcuccugucccugaaggggaagggcagcgugaagaagaaccuccccuucgugauggcgcuggggcugaccgccguccggcucguggaccccaucaacguggucggccugcugcuccugacgcgcuccgggaagcggagcuggccgcccuccgaggugcugaccgccgugggccucaucugcgcccuggcgggcggguucgccaaggccgacaucgagauggccggccccauggccgcggucgggcugcucaucgugagcuacguggucuccggcaagagcguggacauguacaucgagcgcgccggggacaucaccugggagaaggacgccgaggugaccggcaacuccccgcggcuggacgucgcccuggacgagagcggcgacuucucccucguggaggacgacgggccgcccaugcgcgagaucauccugaaggugguccugaugacgaucugcggcaugaaccccaucgccaucccguucgcggccggggccugguacguguacgugaagaccggcaagcggagcggcgcccugugggacguccccgcccccaaggaggugaagaagggggagaccaccgacggcguguaccgcgucaugacgcggcgccuccuggggagcacccaggugggcgugggggucaugcaggagggcguguuccacaccauguggcacgugaccaagggcuccgcgcugcggagcggggagggccgccucgaccccuacuggggcgacgucaagcaggaccugguguccuacugcgggccguggaagcuggacgccgccugggacgggcacagcgaggugcagcuccuggccgucccgcccggcgagcgggcgcgcaacauccagacgcugcccggcaucuucaagaccaaggacggggacaucggcgccguggcccucgacuacccggccgggaccuccggcagccccauccuggacaagugcgggcgcgugaucggccuguacggcaacggggucgugaucaagaacggcuccuacgucagcgccaucacccaggggcggcgcgaggaggagacgcccguggagugcuucgagcccuccaugcucaagaagaagcagcugaccgugcuggaccuccacccgggcgcggggaagacccggcgcguccugcccgagaucgugcgggaggccaucaagacccgccugcggacggugauccucgcccccacccgcgucguggccgccgagauggaggaggcgcugcggggccugcccgugcgcuacaugaccaccgccgucaacgugacgcacagcggcaccgagaucguggaccucaugugccacgccaccuucaccucccggcugcugcagccgauccgcguccccaacuacaaccucuacaucauggacgaggcccacuucacggaccccagcuccaucgccgcgcggggguacaucagcacccgcguggagaugggcgaggccgccgccaucuucaugaccgccaccccgccggggacccgggacgcguuccccgacuccaacagccccaucauggacacggagguggagguccccgagcgcgccugguccagcggcuucgacugggugaccgaccacuccggcaagaccgugugguucgucccgagcgugcggaacgggaacgagaucgccgccugccugaccaaggcgggcaagcgcgugauccagcugagccggaagacguucgagaccgaguuccagaagaccaagcaccaggagugggacuucgucgugaccacggacaucuccgagaugggggccaacuucaaggccgaccgcgugaucgacagccggcgcugccucaagcccgucauccuggacggcgagcgcgugauccuggccgggcccaugcccgugacccacgccuccgcggcccagcggcgcggccggaucggccgcaacccgaacaagcccggggacgaguaccucuacggcgggggcugcgccgagaccgacgaggaccacgcccacuggcuggaggcccggaugcugcucgacaacaucuaccugcaggacgggcugaucgcgagccucuaccgccccgaggccgacaaggucgccgccaucgagggcgaguucaagcugcggaccgagcagcgcaagacguucguggagcugaugaagcggggcgaccucccgguguggcuggccuaccaggucgcguccgccgggaucaccuacaccgaccgccgguggugcuucgacggcaccacgaacaacaccaucauggaggacagcgugcccgccgagguguggacccgccacggggagaagcggguccugaagccccgcuggauggacgcccgggugugcuccgaccacgcggcccucaagagcuucaaggaguucgccgccggcaagcgcggggccgcguucggcgugauggaggcccugggcacccugcccgggcacaugacggagcgguuccaggaggccaucgacaaccucgccguccugaugcgcgccgagaccggcucccggccguacaaggcggccgccgcccagcugcccgagacccucgagaccaucaugcugcuggggcuccugggcacggugagccugggcaucuucuucgugcucaugcgcaacaaggggaucggcaagaugggguucggcauggucacccugggggccuccgcguggcugauguggcucagcgagaucgagcccgcccgcaucgccugcgugcugaucguggucuuccugcuccugguggugcugauccccgagccggagaagcagcgguccccgcaggacaaccagauggccaucaucaucauggucgcggugggccuccugggccugaucaccgccaacgagcucggguggcuggagcgcaccaagagcgaccugucccaccucaugggccggcgcgaggagggggccacgaucggcuucagcauggacaucgaccugcggcccgccuccgccugggcgaucuacgccgcccugaccaccuucaucacccccgccgugcagcacgccgucacgaccagcuacaacaacuacucccucauggcgauggccacccaggccggggugcuguucggcaugggcaaggggaugccguucuacgccugggacuucggcgugccccugcucaugaucgggugcuacagccagcugaccccgcugacgcucaucgucgccaucauccugcugguggcgcacuacauguaccucauccccggccugcaggccgccgccgcccgcgcggcccagaagcggaccgccgccgggaucaugaagaacccggucguggacggcaucguggucaccgacaucgacaccaugacgaucgacccccagguggagaagaagaugggccaggugcugcucaucgcggucgccgugagcuccgccauccugagccgcaccgccuggggguggggcgaggccggggcgcugaucaccgccgccaccuccacccucugggagggcagccccaacaaguacuggaacuccagcacggccaccucccugugcaacaucuuccgggggagcuaccuggccggcgcgucccucaucuacaccgugacccgcaacgccggccuggucaagcggcgcgggggcgggacgggcgagacccugggcgagaaguggaaggcccggcucaaccagaugagcgcccuggaguucuacuccuacaagaagagcgggaucaccgaggugugccgcgaggaggcccggcgcgcgcugaaggacggcguggccaccgggggccacgccgucucccgggggagcgccaagcuccgcuggcugguggagcggggcuaccugcagcccuacggcaaggugaucgaccuggggugcggccgcgggggcugguccuacuacgcggccacgauccggaagguccaggaggugaagggguacaccaagggcggcccggggcacgaggagcccgugcucguccagagcuacggcuggaacaucgugcgccugaaguccgggguggacgucuuccacauggccgccgagcccugcgacacccugcucugcgacaucggcgagagcuccagcagccccgagguggaggaggcccgcacccugcgggugcuguccauggucggggacuggcucgagaagcgcccgggcgcguucugcaucaaggugcugugccccuacacgagcaccaugauggagacccuggagcggcuccagcgccgguacggcgggggccuggugcgcgucccccugucccggaacagcacccacgagauguacuggguguccggggccaagagcaacacgaucaaguccgugagcaccaccucccagcuccugcugggccgcauggacggcccccggcgcccggucaaguacgaggaggacgugaaccucgggagcggcacccgggccguggucuccugcgccgaggcccccaacaugaagaucaucgggaaccgcaucgagcggauccgcagcgagcacgcggagacgugguucuucgacgagaaccaccccuaccggaccugggccuaccacggcuccuacgaggccccgacccaggggagcgccuccagccugaucaacggcguggugcgccugcucuccaagcccugggacgucgugaccggcgugacggggaucgccaugaccgacaccacccccuacggccagcagcgggucuucaaggagaagguggacacgcgcgugcccgacccgcaggaggggacccggcaggucaugagcauggugagcuccuggcuguggaaggagcugggcaagcacaagcgcccccgcgugugcaccaaggaggaguucaucaacaagguccggagcaacgcggcccucggggccaucuucgaggaggagaaggaguggaagaccgccguggaggccgugaacgacccccgcuucugggcgcuggucgacaaggagcgggagcaccaccuccgcggcgagugccaguccugcguguacaacaugaugggcaagcgggagaagaagcagggggaguucggcaaggccaaggggagccgcgccaucugguacauguggcucggcgcccgguuccuggaguucgaggcgcugggguuccucaacgaggaccacuggaugggccgcgagaacuccggcgggggcguggaggggcugggccugcagcggcucggguacguccuggaggagaugagccgcauccccggcggccggauguacgccgacgacacggccgggugggacacccgcaucucccgguucgaccuggagaacgaggcccucaucaccaaccagauggagaagggccaccgcgcccuggcgcuggccaucaucaaguacaccuaccagaacaagguggucaaggugcuccggccggccgagaaggggaagacggugauggacaucaucagccgccaggaccagcggggcuccggccaggucgugaccuacgcccugaacaccuucaccaaccuggugguccagcucauccgcaacauggaggccgaggaggugcuggagaugcaggaccuguggcuccugcggcgcagcgagaaggugaccaacuggcugcaguccaacgggugggaccggcucaagcgcauggcggucagcggcgacgacugcguggugaagcccaucgacgaccgcuucgcccacgcccugcgguuccugaacgacauggggaagguccgcaaggacacgcaggaguggaagcccuccaccggcugggacaacugggaggaggugcccuucugcagccaccacuucaacaagcuccaccugaaggacgggcgguccaucguggucccgugccgccaccaggacgagcugaucggccgggcccgcgugagccccggcgccgggugguccauccgggagaccgcgugccucgccaagagcuacgcccagauguggcagcugcuguacuuccaccgccgggaccuccgccugauggccaacgcgaucugcuccagcgugcccgucgacugggugcccaccggccggacgaccuggagcauccacgggaagggcgaguggaugaccaccgaggacaugcugguggucuggaaccgcguguggaucgaggagaacgaccacauggaggacaagacgccggugaccaaguggaccgacauccccuaccucgggaagcgggaggaccuguggugcggcucccugaucggccaccgcccccggaccacgugggccgagaacaucaagaacaccgucaacauggugcgccggaucaucggggacgaggagaaguacauggacuaccucagcacccaggugcgcuaccugggcgaggagggguccacccccggcguccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 307 - RNA, 2524 nt, Artificial Sequence
  ZIKV (isolate Z1106033) Polyprotein(93-804) mRNA Design 2 GC
ggggcgcugccuacggagguggcagccaucuccuucucggcaucaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 308 - RNA, 2524 nt, Artificial Sequence
  ZIKV (isolate Z1106033) Polyprotein(93-804) mRNA Design 2 GC
ggggcgcugccuacggagguggcagccaucuccuucucggcaucaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcaccccgcacuggaacaacaaggaggcgcugguggaguucaaggacgcccacgccaagcggcagaccgucguggugcucgggucccaggagggcgccguccacacggcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgccguucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgugggcggcgcccugaacucccucgggaaggggauccaccagaucuucggcgccgcguucaagagccuguucgggggcauguccugguucagccagauccugaucgggacgcuccugauguggcugggccucaacgccaagaacggguccaucagccugaugugccuggcccucggcggcgugcugaucuuccuguccaccgccgucagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 309 - RNA, 1741 nt, Artificial Sequence
  ZIKV (isolate Z1106033) Polyprotein(273-723) mRNA Design 2 GC
ggggcgcugccuacggagguggcagccaucuccuucucggcaucaagcuuaccaugagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 310 - RNA, 1741 nt, Artificial Sequence
  ZIKV (isolate Z1106033) Polyprotein(273-723) mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaacccggugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 311 - RNA, 10642 nt, Artificial Sequence
  ZIKV (strain MR 766) complete polyprotein mRNA Design 2 GC
ggggcgcugccuacggagguggcagccaucuccuucucggcaucaagcuuaccaugaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgccggcagcacggaccacauggaccacuucucccugggcgugcuggucauccuccugauggugcaggaggggcugaagaagcggaugaccaccaagaucaucaugagcaccagcauggccgugcucgucgugaugauccugggcggguucuccaugagcgaccuggccaagcucgugauccugaugggcgcgaccuucgccgagaugaacacgggcggcgacgucgcccaccuggcccucguggccgcguucaaggugcgccccgcccugcuggucuccuucaucuuccgggccaacuggaccccgcgcgagagcaugcuccuggcccuggccuccugccuccugcagaccgcgaucagcgcccuggagggggaccucauggugcugaucaacggguucgcccuggccuggcucgcgauccgggccauggccgugccccgcaccgacaacaucgcccugccgauccuggccgcgcucacgccccuggcccggggcacccugcucgucgccuggcgcgccgggcuggccacgugcggcgggaucaugcugcucucccugaagggcaagggcagcgugaagaagaaccugcccuucgugauggcgcucgggcugaccgccguccgggugguggaccccaucaacgucgugggccugcuccugcugacgcgcuccgggaagcggagcuggccgcccuccgaggugcucaccgccgucggccugaucugcgcccuggccgggggcuucgcgaaggccgacaucgagauggccggccccauggccgcgguggggcuccugaucgugagcuacgucguguccggcaagagcguggacauguacaucgagcgcgccggggacaucaccugggagaaggacgccgaggucaccggcaacuccccgcggcuggacguggcccucgacgagagcggggacuucucccugguggaggaggacggcccgcccaugcgcgagaucauccugaaggucgugcucauggccaucugcggcaugaaccccaucgcgaucccguucgccgccggggccugguacguguacgucaagacgggcaagcggagcggggcccugugggacgugcccgcgcccaaggaggugaagaagggcgagaccaccgacggcgucuaccgcgugaugacccggcgccugcugggguccacccaggugggcgucggggugaugcaggagggcguguuccacaccauguggcacgucaccaagggggccgcccuccggagcggcgagggccgccuggaccccuacuggggcgacgugaagcaggaccuggucagcuacugcgggccguggaagcucgacgccgccugggacgggcuguccgaggugcagcugcucgcggugccgcccggcgagcgcgcccggaacauccagacccugcccgggaucuucaagacgaaggacggcgacaucggcgccgucgcccuggacuacccggcggggaccagcggcucccccauccucgacaagugcgggcgcgugaucggccuguacgggaacggcguggucaucaagaacggcagcuacguguccgccaucacccaggggaagcgggaggaggagacccccguggagugcuucgagcccagcaugcugaagaagaagcagcucacgguccuggaccugcacccgggcgccgggaagacccgccgggugcuccccgagaucgugcgcgaggccaucaagaagcggcugcgcaccgucauccuggcccccacccgggugguggcggccgagauggaggaggcccuccgcggccugcccguccgguacaugacgaccgccgugaacgugacccacuccgggaccgagaucgucgaccugaugugccacgccacguucaccagccgccuccugcagccgauccgggugcccaacuacaaccugaacaucauggacgaggcgcacuucaccgaccccuccagcaucgccgcccgcggcuacaucuccacccggguggagaugggcgaggccgccgcgaucuucaugacggccaccccgccggggacccgcgacgccuuccccgacagcaacucccccaucauggacaccgaggucgaggugcccgagcgggccuggagcuccggcuucgacugggugaccgaccacagcgggaagacggucugguucgugccguccgugcgcaacggcaacgagaucgccgcgugccucaccaaggccggcaagcgggucauccagcugagccgcaagaccuucgagaccgaguuccagaagacgaagaaccaggagugggacuucgugaucaccaccgacaucuccgagaugggggccaacuucaaggccgaccgggugaucgacagccgccgcugccugaagcccgucauccucgacggcgagcgggugauccuggcggggcccaugcccgugacccacgccagcgccgcccagcgccggggccgcaucgggcggaacccgaacaagcccggcgacgaguacauguacggcgggggcugcgccgagacggacgaggggcacgcgcacuggcuggaggcccgcaugcuccuggacaacaucuaccugcaggacggccucaucgccucccuguaccggcccgaggccgacaaggucgccgcgaucgagggggaguucaagcugcgcaccgagcagcggaagaccuucguggagcucaugaagcgcggcgaccugccgguguggcuggccuaccaggucgccagcgccggcaucaccuacacggaccggcgcuggugcuucgacgggaccaccaacaacaccaucauggaggacuccgugcccgccgagguguggacgaaguacggcgagaagcggguccucaagccccgcuggauggacgcgcgggugugcagcgaccacgccgcccugaaguccuucaaggaguucgccgcggggaagcgcggcgccgcccugggggugauggaggcccucggcacccugcccggccacaugaccgagcgguuccaggaggccaucgacaaccuggcgguccucaugcgcgccgagaccgggagccggccguacaaggccgccgccgcgcagcugcccgagacgcuggagaccaucaugcuccugggccugcucgggaccgugucccugggcaucuucuucgugcugaugcgcaacaagggcaucgggaagaugggcuucgggauggucacccucggcgccagcgccuggcugauguggcuguccgagaucgagcccgcccgcaucgccugcgugcucaucguggucuuccugcugcucguggugcugauccccgagccggagaagcagcggagcccccaggacaaccagauggcgaucaucaucauggucgccguggggcugcucggccugaucacggccaacgagcugggcuggcucgagcgcaccaagaacgacaucgcccaccugauggggcggcgcgaggagggcgcgaccaugggguucuccauggacaucgaccugcggcccgccagcgccugggccaucuacgccgcgcucaccacgcugaucacccccgccguccagcacgccgugaccaccuccuacaacaacuacagccugauggccauggccacgcaggcgggcgugcucuucgggaugggcaagggcaugccguucaugcacggggaccugggcgucccgcugcucaugauggggugcuacucccagcugaccccgcugacccucaucguggccaucauccugcugguggcccacuacauguaccucauccccggccugcaggccgccgcggcccgcgccgcccagaagcggaccgccgcggggaucaugaagaacccggucguggacggcaucguggucacggacaucgacaccaugaccaucgacccccagguggagaagaagaugggccaggugcugcucaucgccgucgccaucagcuccgccgugcugcugcgcaccgcguggggguggggcgaggccggggcccucaucacggccgccaccagcacccugugggagggcucccccaacaaguacuggaacagcagcaccgcgaccucccugugcaacaucuuccgggggagcuaccucgccggcgccucccugaucuacacggugacccgcaacgccggccuggucaagcggcgcgggggcgggaccggcgagacccucggcgagaaguggaaggcccggcugaaccagaugagcgcgcuggaguucuacuccuacaagaagagcgggaucacggaggugugccgcgaggaggcccggcgcgcccucaaggacggcguggccaccgggggccacgccgucucccgggggagcgcgaagauccgcuggcuggaggagcggggcuaccugcagcccuacggcaaggugguggaccuggggugcggccgcgggggcugguccuacuacgccgccaccauccggaagguccaggaggugcgcggguacaccaagggcggcccggggcacgaggagcccaugcucgugcagagcuacggcuggaacaucguccgccugaaguccgggguggacguguuccacauggccgcggagcccugcgacacgcugcucugcgacaucggcgagagcuccagcucccccgaggucgaggagacccggacccugcgcgugcugagcauggugggggacuggcucgagaagcggccgggcgccuucugcaucaagguccugugccccuacaccuccacgaugauggagaccauggagcgccugcagcggcgccacggcgggggccucgugcgggugccccugugccgcaacagcacccacgagauguacugggucuccggggccaagagcaacaucaucaagagcguguccaccacgagccagcugcuccugggccggauggacggcccccgccggccggugaaguacgaggaggacgucaaccugggguccggcacccgcgccguggccagcugcgcggaggcccccaacaugaagaucaucgggcggcgcaucgagcggauccgcaacgagcacgccgagaccugguuccucgacgagaaccaccccuaccggaccugggccuaccacggcuccuacgaggccccgacgcaggggagcgcguccagccuggugaacggcgucgugcgccugcucuccaagcccugggacguggucaccggcgugaccgggaucgccaugaccgacacgacccccuacggccagcagcggguguucaaggagaaggucgacacccgcgugcccgacccgcaggaggggacccgccaggugaugaacaucgucagcuccuggcuguggaaggagcugggcaagcggaagcgcccccgggugugcacgaaggaggaguucaucaacaaggugcgcagcaacgccgcccucggggccaucuucgaggaggagaaggaguggaagaccgcggucgaggccgugaacgacccccgguucugggcccuggucgaccgcgagcgggagcaccaccuccgcggcgagugccacuccugcguguacaacaugaugggcaagcgggagaagaagcagggggaguucggcaaggccaaggggagccgcgccaucugguacauguggcucggcgcgcgguuccuggaguucgaggcccugggguuccucaacgaggaccacuggaugggccgcgagaacuccggcgggggcguggaggggcugggccugcagcggcucggguacauccuggaggagaugaaccgcgcccccggcggcaagauguacgccgacgacaccgcggggugggacacccggaucagcaaguucgaccuggagaacgaggcccucaucacgaaccagauggaggagggccaccgcacccuggcccuggccgucaucaaguacaccuaccagaacaagguggugaagguccuccggccggccgagggcgggaagaccgugauggacaucaucucccgccaggaccagcggggcagcggccagguggucacguacgcgcugaacaccuucaccaaccugguggugcagcucauccgcaacauggaggccgaggagguccuggagaugcaggaccuguggcuccugcggaagcccgagaaggugacccgcuggcugcagagcaacggcugggaccgccucaagcggauggccguguccggggacgacugcgucgugaagcccaucgacgaccgcuucgcccacgcccugcgguuccugaacgacaugggcaaggugcgcaaggacacccaggaguggaagcccagcacggggugguccaacugggaggaggucccguucugcagccaccacuucaacaagcucuaccugaaggacggccgguccaucguggugcccugccgccaccaggacgagcugaucggccgggcgcgcgucagccccggggccggcugguccauccgggagaccgccugccucgccaagagcuacgcccagauguggcagcugcuguacuuccaccgccgggaccuccgccugauggcgaacgccaucugcuccgccgugcccguggacugggucccgaccgggcggaccacguggagcauccacggcaagggggaguggaugaccaccgaggacaugcugaugguguggaaccgcguguggaucgaggagaacgaccacauggaggacaagacccccgucacgaaguggaccgacauccccuaccucggcaagcgggaggaccuguggugcggcucccugaucgggcaccgcccccggaccaccugggccgagaacaucaaggacacggugaacauggugcgccggaucaucggcgacgaggagaaguacauggacuaccucagcacccagguccgcuaccugggggaggagggcuccaccccgggggugcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 312 - RNA, 2512 nt, Artificial Sequence
  ZIKV (strain MR 766) Polyprotein(93-800) mRNA Design 2 GC
ggggcgcugccuacggagguggcagccaucuccuucucggcaucaagcuuaccaugcggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 313 - RNA, 2512 nt, Artificial Sequence
  ZIKV (strain MR 766) Polyprotein(93-800) mRNA Design 2 GC
ggggcgcugccuacggagguggcagccaucuccuucucggcaucaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucaccugcagcaagaagaugaccggcaaguccauccagcccgagaaccuggaguaccgcaucaugcugagcgugcacggcucccagcacagcgggaugaucggcuacgagaccgacgaggaccgcgccaaggucgaggugacgcccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggccgccucuucuccgggcaccugaagugccggcugaagauggacaagcuccgccugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcggcugaucacggccaacccggugaucaccgagagcaccgagaacuccaagaugaugcucgagcuggacccgcccuucggcgacagcuacaucgugaucggggucggcgacaagaagaucacccaccacuggcaccgcuccgggagcacgaucggcaaggccuucgaggcgaccgugcggggcgccaagcgcauggccgugcugggggacaccgccugggacuucggcagcgucgggggcguguucaacucccuggggaagggcauccaccagaucuucggcgccgcguucaagagccucuucgggggcauguccugguucagccagauccugaucgggacccugcucguguggcugggccugaacacgaagaacggguccaucagccucaccugccuggcccugggcggcgucaugaucuuccucuccaccgccgugagcgccgacguggggugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 314 - RNA, 1729 nt, Artificial Sequence
  ZIKV (strain MR 766) Polyprotein(273-719) mRNA Design 2 GC
ggggcgcugccuacggagguggcagccaucuccuucucggcaucaagcuuaccaugucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 315 - RNA, 1729 nt, Artificial Sequence
  ZIKV (strain MR 766) Polyprotein(273-719) mRNA Design 2 GC
ggggcgcugccuacggagguggcagccaucuccuucucggcaucaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagccgacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcucuucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgaggaccgggccaagguggaggugacccccaacuccccgcgcgccgaggccacgcugggcggguucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcuguucagcgggcaccugaagugccgccucaagauggacaagcugcggcugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcgccucaucacggccaacccggucaucaccgaguccaccgagaacagcaagaugaugcuggagcuggacccgcccuucggcgacuccuacaucgugaucggggugggcgacaagaagaucacccaccacuggcaccggagcggguccacgaucggcaaggccuucgaggccaccguccgcggcgccaagcggauggcggugcucggggacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 316 - RNA, 2524 nt, Artificial Sequence
  ZIKV (strain ZikaSPH2015) Polyprotein(93-804) mRNA Design 2 opimized
ggggcgcugccuacggagguggcagccaucuccuucucggcaucaagcuuaccaugcggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacaccaagaacggcagcaucucccugaugugccuggcucugggaggcgugcugaucuuccugagcacagccgugucugccgacgugggcugcagcguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 317 - RNA, 1741 nt, Artificial Sequence
  ZIKV (strain ZikaSPH2015) Polyprotein(273-723) mRNA Design 2 opimized
ggggcgcugccuacggagguggcagccaucuccuucucggcaucaagcuuaccaugucccagaaagugaucuaccucgugaugauccugcugaucgccccugccuacagcauccgguguaucggcguguccaaccgggacuucguggaaggcaugagcggcggcacauggguggacaucgugcuggaacacggcggcugcgugacagugauggcccaggauaagcccaccguggauaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggcuguggacaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 318 - RNA, 2524 nt, Artificial Sequence
  ZIKV (isolate Z1106033) Polyprotein(93-804) mRNA Design 2 opimized
ggggcgcugccuacggagguggcagccaucuccuucucggcaucaagcuuaccaugcggaucaucaacgcccggaaagagaagaagcgcagaggcgccgauaccagcgugggcauugugggccugcugcugacaacagccauggccgccgaagugaccagaagaggcagcgccuacuacauguaccuggaccggaacgaugccggcgaggccaucagcuuuccaaccacccugggcaugaacaagugcuacauccagaucauggaccugggccacaccugugacgccaccaugagcuacgagugccccaugcuggacgagggcguggaacccgacgauguggacugcuggugcaacaccaccagcaccugggugguguacggcaccugucaccacaagaagggcgaagccagacgguccagacgggccgugacacugccuagccacagcaccagaaagcugcagacccggucccagaccuggcuggaaagcagagaguacaccaagcaccugauccggguggaaaacuggaucuuccggaaccccggcuuugcccuggccgcugcugcuauugcuuggcugcugggcagcagcaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucugugggcggagcccugaacucucugggcaagggaauccaccagaucuucggagccgccuuuaagagccuguucggcggcauguccugguucagccagauccugaucggcacccugcugauguggcugggccugaacgccaagaacggcagcaucucccugaugugccuggcucugggaggcgugcugaucuuccugagcacagccgugucugccgacgugggcugcagcguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 319 - RNA, 1741 nt, Artificial Sequence
  ZIKV (isolate Z1106033) Polyprotein(273-723) mRNA Design 2 opimized
ggggcgcugccuacggagguggcagccaucuccuucucggcaucaagcuuaccaugucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcucaggacaagcccaccguggacaucgagcucgugaccaccaccguguccaauauggccgaagugcggagcuacugcuacgaggccagcaucagcgacauggccagcgacagcagaugcccuacacagggcgaggccuaccuggacaagcaguccgacacccaguacgugugcaagcggacccugguggauagaggcuggggcaauggcugcggccuguuuggcaagggcagccucgugaccugcgccaaguucgccugcagcaagaagaugaccggcaagagcauccagcccgagaaccuggaauaccggaucaugcugagcgugcacggcagccagcacuccggcaugaucgugaacgacaccggccacgagacagacgagaaccgggccaagguggaaaucacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagaggcagaccgugguggugcugggaucucaggaaggcgccgugcauacagcucuggcuggcgcccuggaagccgaaauggauggcgcuaagggcagacuguccagcggccaccugaagugccggcugaagauggacaagcugcggcugaagggcguguccuacagccuguguaccgccgccuucaccuucaccaagauccccgccgagacacugcacggcaccgugacuguggaagugcaguacgccggcaccgacggcccuuguaaagugccugcucagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggggagaagaagaucacccaccacuggcacagaagcggcagcaccaucggcaaggccuuugaggcuacagugcggggagccaagagaauggccgugcugggagauaccgccugggacuuuggcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 320 - RNA, 2512 nt, Artificial Sequence
  ZIKV (strain MR 766) Polyprotein(93-800) mRNA Design 2 opimized
ggggcgcugccuacggagguggcagccaucuccuucucggcaucaagcuuaccaugcggaucaucaacgcccggaaagagcggaagcggagaggcgccgauaccagcaucggcaucaucggccugcugcugaccacagccauggccgccgagaucaccagaagaggcagcgccuacuacauguaccuggacagaagcgacgccggcaaggccaucagcuuugccacaacccugggcgugaacaagugccacgugcagaucauggaccugggccacaugugcgacgccaccaugagcuacgagugccccaugcuggacgagggcguggaacccgacgauguggacugcuggugcaacaccaccagcaccugggugguguacggcaccugucaccacaagaagggcgaggccagacggucuagaagggccgugacacugccuagccacagcacccggaagcugcagaccagaagccagaccuggcuggaaagcagagaguacaccaagcaccugaucaagguggaaaacuggaucuuccggaaccccggcuucgcccugguggccguggcuauugcuuggcugcugggcagcuccaccucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucugugggcggcguguucaacucccugggcaagggaauccaccagaucuucggagccgccuuuaagagccuguucggcggcaugagcugguucagccagauccugaucggcacccugcucguguggcugggccugaacaccaagaacggcagcaucucccugaccugccuggcucugggcggagugaugaucuuccugagcaccgccguguccgccgaugugggcuguagcguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 321 - RNA, 1729 nt, Artificial Sequence
  ZIKV (strain MR 766) Polyprotein(273-719) mRNA Design 2 opimized
ggggcgcugccuacggagguggcagccaucuccuucucggcaucaagcuuaccaugucccagaaagugaucuaccucgugaugauccugcugaucgccccugccuacagcauccgguguaucggcguguccaaccgggacuucguggaaggcaugagcggcggcacauggguggacguggugcuggaacauggcggcugcgugacagugauggcccaggacaagcccaccguggacaucgagcucgugaccaccaccguguccaauauggccgaagugcggagcuacugcuacgaggccagcaucagcgacauggccagcgacagcagaugcccuacacagggggaggccuaccuggauaagcaguccgacacccaguacgugugcaagcggacccugguggauagaggcuggggcaauggcugcggccuguuuggcaagggcagccucgugaccugcgccaaguucaccuguagcaagaagaugaccggcaagagcauccagcccgagaaccuggaauaccggaucaugcugagcgugcacggcagccagcacagcggaaugaucggcuacgagacagacgaggaccgggccaaaguggaagugacccccaacagcccuagagccgaggccacacugggcggcuuuggaucucugggccuggacugcgagccuagaaccggccuggauuucagcgaccuguacuaccugaccaugaacaacaagcacuggcuggugcacaaagagugguuccacgacaucccccugcccuggcaugccggcgcugauacaggcacaccccacuggaacaacaaagaggcucugguggaguucaaggacgcccacgccaagagacagaccgugguggugcugggcucucaggaaggcgccgugcauacagcucuggcuggcgcccuggaagccgaaauggauggcgccaagggcagacuguucagcggccaccugaagugccggcugaagauggacaagcugcggcugaagggcguguccuacagccuguguaccgccgccuucaccuucaccaaggugcccgccgaaacccugcacggcacagugacuguggaagugcaguacgccggcaccgacggcccuugcaagaucccugugcagauggccguggauaugcagacccugaccccugugggcaggcugaucaccgccaacccugugaucaccgagagcaccgagaacagcaagaugaugcuggaacuggacccacccuucggcgacagcuacaucgugaucggcgugggagacaagaagaucacccaccacuggcaccgcagcggcagcacaaucggaaaggccuucgaagccacagugcggggagccaagagaauggccgugcugggagauaccgccugggacuuuggcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 322 - RNA, 2524 nt, Artificial Sequence
  ZIKV (strain ZikaSPH2015) Polyprotein(93-804) mRNA Design 2 opimized
ggggcgcugccuacggagguggcagccaucuccuucucggcaucaagcuuaccaugcggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacaccaagaacggcagcauuagccugaugugccuggcccugggcggcgugcugaucuuccugagcaccgccguguccgccgacgugggcugcagcguggacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 323 - RNA, 1741 nt, Artificial Sequence
  ZIKV (strain ZikaSPH2015) Polyprotein(273-723) mRNA Design 2 opimized
ggggcgcugccuacggagguggcagccaucuccuucucggcaucaagcuuaccaugagccagaaagugaucuaccuggugaugauccugcugaucgccccugccuacagcauccggugcaucggcguguccaaccgggacuucguggaaggcaugagcggcggcacauggguggacaucgugcuggaacacggcggcugcgugaccgugauggcccaggacaagcccaccguggauaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccuggucgaguucaaggacgcccacgccaagcggcagaccgugguggugcugggaucucaggaaggcgccguccacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuuguaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 324 - RNA, 2524 nt, Artificial Sequence
  ZIKV (isolate Z1106033) Polyprotein(93-804) mRNA Design 2 opimized
ggggcgcugccuacggagguggcagccaucuccuucucggcaucaagcuuaccaugcggaucaucaacgcccggaaagagaagaagcgcagaggcgccgacaccagcgugggcaucgugggccugcugcugacaaccgccauggccgccgaagugaccagacggggcagcgccuacuacauguaccuggaccggaacgacgccggcgaggccaucagcuuucccaccacccugggcaugaacaagugcuacauccagaucauggaccugggccacaccugugacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugauccggguggaaaacuggaucuuccggaaccccggcuucgcccuggccgcugccgcuauugcuuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucugugggcggagcccugaacagccugggcaagggcauccaccagaucuucggagccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccguguccgccgacgugggcugcagcguggacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 325 - RNA, 1741 nt, Artificial Sequence
  ZIKV (isolate Z1106033) Polyprotein(273-723) mRNA Design 2 opimized
ggggcgcugccuacggagguggcagccaucuccuucucggcaucaagcuuaccaugagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucgccugcagcaagaagaugaccggcaagagcauccagcccgagaaccuggaauaccggaucaugcugagcgugcacggcagccagcacagcggcaugaucgugaacgacaccggccacgagacagacgagaaccgggccaagguggaaaucacccccaacagccccagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggcaggcugagcagcggccaccugaagugccggcugaagauggacaagcugcggcugaagggcguguccuacagccugugcaccgccgccuucaccuucaccaagauccccgccgagacacugcacggcaccgugaccguggaagugcaguacgccggcaccgacggcccuugcaaggugccagcccagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgagaagaagaucacccaccacuggcacagaagcggcagcaccaucggcaaggccuucgaggccacagugcggggagccaagagaauggccgugcugggcgacaccgccugggacuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 326 - RNA, 2512 nt, Artificial Sequence
  ZIKV (strain MR 766) Polyprotein(93-800) mRNA Design 2 opimized
ggggcgcugccuacggagguggcagccaucuccuucucggcaucaagcuuaccaugcggaucaucaacgcccggaaagagcggaagcggagaggcgccgacaccagcaucggcaucaucggccugcugcugaccaccgccauggccgccgagaucaccagacggggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggaacccgacgacguggacugcuggugcaacaccaccagcaccugggugguguacggcaccugucaccacaagaagggcgaggccagacgguccagacgggccgugacacugcccagccacagcacccggaagcugcagaccagaagccagaccuggcuggaaagcagagaguacaccaagcaccugaucaagguggaaaacuggaucuuccggaaccccggcuucgcccugguggccguggcuauugccuggcugcugggcagcagcaccagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcuccgugggcggcguguucaacagccugggcaagggcauccaccagaucuucggagccgccuucaagagccuguucggcggcaugagcugguucagccagauccugaucggcacccugcuggucuggcugggccugaacaccaagaacggcagcaucagccugaccugccuggcccugggcggagugaugaucuuccugagcaccgccgugucugccgacgugggcugcagcguggacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 327 - RNA, 1729 nt, Artificial Sequence
  ZIKV (strain MR 766) Polyprotein(273-719) mRNA Design 2 opimized
ggggcgcugccuacggagguggcagccaucuccuucucggcaucaagcuuaccaugagccagaaagugaucuaccuggugaugauccugcugaucgccccugccuacagcauccggugcaucggcguguccaaccgggacuucguggaaggcaugagcggcggcacauggguggacguggugcuggaacacggcggcugcgugaccgugauggcccaggacaagcccaccguggacaucgagcuggugacaaccaccguguccaacauggccgaagugcggagcuacugcuacgaggccagcaucagcgacauggccagcgacagcagaugccccacccagggggaggccuaccuggacaagcagagcgacacccaguacgugugcaagcggacccugguggacagaggcuggggcaacggcugcggccuguuuggcaagggcagccuggugacaugcgccaaguucaccuguagcaagaagaugaccggcaagagcauccagcccgagaaccuggaauaccggaucaugcugagcgugcacggcagccagcacagcggcaugaucggcuacgagacagacgaggaccgggccaagguggaagugacccccaacagcccuagagccgaggccacacugggcggcuuuggcagccugggccuggacugcgagcccagaaccggccuggacuucagcgaccuguacuaccugaccaugaacaacaagcacuggcuggugcacaaagagugguuccacgacaucccccugcccuggcacgcuggcgccgauacaggcaccccucacuggaacaacaaagaggcccugguggaguucaaggacgcccacgccaagcggcagaccgugguggugcugggaucucaggaaggcgccgugcacacagcccuggcuggcgcccuggaagccgagauggauggcgccaagggccggcuguucagcggccaccugaagugccggcugaagauggacaagcugcggcugaagggcguguccuacagccugugcaccgccgccuucaccuucaccaaggugcccgccgagacacugcacggcaccgugaccguggaagugcaguacgccggcaccgacggccccugcaagaucccugugcagauggccguggacaugcagacccugacccccgugggccggcugaucaccgccaacccugugaucaccgagagcaccgagaacagcaagaugaugcuggaacuggacccacccuucggcgacagcuacaucgugaucggcgugggcgacaagaagaucacccaccacuggcacagaagcggcagcaccaucggcaaggccuucgaggccacagugcggggagccaagagaauggccgugcugggcgacaccgccugggauuuuggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 328 - RNA, 10654 nt, Artificial Sequence
  ZIKV (strain ZikaSPH2015) complete polyprotein mRNA Design 2 optimized
ggggcgcugccuacggagguggcagccaucuccuucucggcaucaagcuuaccaugaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgacuacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaugggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugauggccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 329 - RNA, 2524 nt, Artificial Sequence
  ZIKV (strain ZikaSPH2015) Polyprotein(93-804) mRNA Design 2 opimized
ggggcgcugccuacggagguggcagccaucuccuucucggcaucaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 330 - RNA, 2524 nt, Artificial Sequence
  ZIKV (strain ZikaSPH2015) Polyprotein(93-804) mRNA Design 2 opimized
ggggcgcugccuacggagguggcagccaucuccuucucggcaucaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 331 - RNA, 1741 nt, Artificial Sequence
  ZIKV (strain ZikaSPH2015) Polyprotein(273-723) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 332 - RNA, 1741 nt, Artificial Sequence
  ZIKV (strain ZikaSPH2015) Polyprotein(273-723) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 333 - RNA, 10654 nt, Artificial Sequence
  ZIKV (isolate Z1106033) complete polyprotein mRNA Design 2 optimized
ggggcgcugccuacggagguggcagccaucuccuucucggcaucaagcuuaccaugaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaucagcaccagcauggccgugcugguggccaugauccugggcggcuucagcaugagcgaccuggccaagcuggccauccugaugggcgccaccuucgccgagaugaacaccggcggcgacguggcccaccuggcccugaucgccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccaugguggugccccgcaccgacaacaucacccuggccauccuggccgcccugaccccccuggcccgcggcacccugcugguggccuggcgcgccggccuggccaccugcggcggcuucaugcugcugagccugaagggcaagggcagcgugaagaagaaccugcccuucgugauggcccugggccugaccgccgugcgccugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggacgacggcccccccaugcgcgagaucauccugaagguggugcugaugaccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcagcgcccugcgcagcggcgagggccgccuggaccccuacuggggcgacgugaagcaggaccuggugagcuacugcggccccuggaagcuggacgccgccugggacggccacagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggccgccgcgaggaggagacccccguggagugcuucgagcccagcaugcugaagaagaagcagcugaccgugcuggaccugcaccccggcgccggcaagacccgccgcgugcugcccgagaucgugcgcgaggccaucaagacccgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccuguacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagcaccaggagugggacuucguggugaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguaccuguacggcggcggcugcgccgagaccgacgaggaccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggacccgccacggcgagaagcgcgugcugaagccccgcuggauggacgcccgcgugugcagcgaccacgccgcccugaagagcuucaaggaguucgccgccggcaagcgcggcgccgccuucggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagagcgaccugagccaccugaugggccgccgcgaggagggcgccaccaucggcuucagcauggacaucgaccugcgccccgccagcgccugggccaucuacgccgcccugaccaccuucaucacccccgccgugcagcacgccgugaccaccagcuacaacaacuacagccugauggccauggccacccaggccggcgugcuguucggcaugggcaagggcaugcccuucuacgccugggacuucggcgugccccugcugaugaucggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccgugagcagcgccauccugagccgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagcugcgcuggcugguggagcgcggcuaccugcagcccuacggcaaggugaucgaccugggcugcggccgcggcggcuggagcuacuacgccgccaccauccgcaaggugcaggaggugaagggcuacaccaagggcggccccggccacgaggagcccgugcuggugcagagcuacggcuggaacaucgugcgccugaagagcggcguggacguguuccacauggccgccgagcccugcgacacccugcugugcgacaucggcgagagcagcagcagccccgagguggaggaggcccgcacccugcgcgugcugagcauggugggcgacuggcuggagaagcgccccggcgccuucugcaucaaggugcugugccccuacaccagcaccaugauggagacccuggagcgccugcagcgccgcuacggcggcggccuggugcgcgugccccugagccgcaacagcacccacgagauguacugggugagcggcgccaagagcaacaccaucaagagcgugagcaccaccagccagcugcugcugggccgcauggacggcccccgccgccccgugaaguacgaggaggacgugaaccugggcagcggcacccgcgccguggugagcugcgccgaggcccccaacaugaagaucaucggcaaccgcaucgagcgcauccgcagcgagcacgccgagaccugguucuucgacgagaaccaccccuaccgcaccugggccuaccacggcagcuacgaggcccccacccagggcagcgccagcagccugaucaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugagcauggugagcagcuggcuguggaaggagcugggcaagcacaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggacaaggagcgcgagcaccaccugcgcggcgagugccagagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacgugcuggaggagaugagccgcauccccggcggccgcauguacgccgacgacaccgccggcugggacacccgcaucagccgcuucgaccuggagaacgaggcccugaucaccaaccagauggagaagggccaccgcgcccuggcccuggccaucaucaaguacaccuaccagaacaagguggugaaggugcugcgccccgccgagaagggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgccgcagcgagaaggugaccaacuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcugggacaacugggaggaggugcccuucugcagccaccacuucaacaagcugcaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcagcgugcccguggacugggugcccaccggccgcaccaccuggagcauccacggcaagggcgaguggaugaccaccgaggacaugcuggugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaagaacaccgugaacauggugcgccgcaucaucggcgacgaggagaaguacauggacuaccugagcacccaggugcgcuaccugggcgaggagggcagcacccccggcgugcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 334 - RNA, 2524 nt, Artificial Sequence
  ZIKV (isolate Z1106033) Polyprotein(93-804) mRNA Design 2 opimized
ggggcgcugccuacggagguggcagccaucuccuucucggcaucaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 335 - RNA, 2524 nt, Artificial Sequence
  ZIKV (isolate Z1106033) Polyprotein(93-804) mRNA Design 2 opimized
ggggcgcugccuacggagguggcagccaucuccuucucggcaucaagcuuaccaugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 336 - RNA, 1741 nt, Artificial Sequence
  ZIKV (isolate Z1106033) Polyprotein(273-723) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 337 - RNA, 1741 nt, Artificial Sequence
  ZIKV (isolate Z1106033) Polyprotein(273-719) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 338 - RNA, 10642 nt, Artificial Sequence
  ZIKV (strain MR 766) complete polyprotein mRNA Design 2 optimized
ggggcgcugccuacggagguggcagccaucuccuucucggcaucaagcuuaccaugaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgccggcagcaccgaccacauggaccacuucagccugggcgugcuggugauccugcugauggugcaggagggccugaagaagcgcaugaccaccaagaucaucaugagcaccagcauggccgugcugguggugaugauccugggcggcuucagcaugagcgaccuggccaagcuggugauccugaugggcgccaccuucgccgagaugaacaccggcggcgacguggcccaccuggcccugguggccgccuucaaggugcgccccgcccugcuggugagcuucaucuuccgcgccaacuggaccccccgcgagagcaugcugcuggcccuggccagcugccugcugcagaccgccaucagcgcccuggagggcgaccugauggugcugaucaacggcuucgcccuggccuggcuggccauccgcgccauggccgugccccgcaccgacaacaucgcccugcccauccuggccgcccugaccccccuggcccgcggcacccugcugguggccuggcgcgccggccuggccaccugcggcggcaucaugcugcugagccugaagggcaagggcagcgugaagaagaaccugcccuucgugauggcccugggccugaccgccgugcgcgugguggaccccaucaacguggugggccugcugcugcugacccgcagcggcaagcgcagcuggccccccagcgaggugcugaccgccgugggccugaucugcgcccuggccggcggcuucgccaaggccgacaucgagauggccggccccauggccgccgugggccugcugaucgugagcuacguggugagcggcaagagcguggacauguacaucgagcgcgccggcgacaucaccugggagaaggacgccgaggugaccggcaacagcccccgccuggacguggcccuggacgagagcggcgacuucagccugguggaggaggacggcccccccaugcgcgagaucauccugaagguggugcugauggccaucugcggcaugaaccccaucgccauccccuucgccgccggcgccugguacguguacgugaagaccggcaagcgcagcggcgcccugugggacgugcccgcccccaaggaggugaagaagggcgagaccaccgacggcguguaccgcgugaugacccgccgccugcugggcagcacccaggugggcgugggcgugaugcaggagggcguguuccacaccauguggcacgugaccaagggcgccgcccugcgcagcggcgagggccgccuggaccccuacuggggcgacgugaagcaggaccuggugagcuacugcggccccuggaagcuggacgccgccugggacggccugagcgaggugcagcugcuggccgugccccccggcgagcgcgcccgcaacauccagacccugcccggcaucuucaagaccaaggacggcgacaucggcgccguggcccuggacuaccccgccggcaccagcggcagccccauccuggacaagugcggccgcgugaucggccuguacggcaacggcguggugaucaagaacggcagcuacgugagcgccaucacccagggcaagcgcgaggaggagacccccguggagugcuucgagcccagcaugcugaagaagaagcagcugaccgugcuggaccugcaccccggcgccggcaagacccgccgcgugcugcccgagaucgugcgcgaggccaucaagaagcgccugcgcaccgugauccuggcccccacccgcgugguggccgccgagauggaggaggcccugcgcggccugcccgugcgcuacaugaccaccgccgugaacgugacccacagcggcaccgagaucguggaccugaugugccacgccaccuucaccagccgccugcugcagcccauccgcgugcccaacuacaaccugaacaucauggacgaggcccacuucaccgaccccagcagcaucgccgcccgcggcuacaucagcacccgcguggagaugggcgaggccgccgccaucuucaugaccgccaccccccccggcacccgcgacgccuuccccgacagcaacagccccaucauggacaccgagguggaggugcccgagcgcgccuggagcagcggcuucgacugggugaccgaccacagcggcaagaccgugugguucgugcccagcgugcgcaacggcaacgagaucgccgccugccugaccaaggccggcaagcgcgugauccagcugagccgcaagaccuucgagaccgaguuccagaagaccaagaaccaggagugggacuucgugaucaccaccgacaucagcgagaugggcgccaacuucaaggccgaccgcgugaucgacagccgccgcugccugaagcccgugauccuggacggcgagcgcgugauccuggccggccccaugcccgugacccacgccagcgccgcccagcgccgcggccgcaucggccgcaaccccaacaagcccggcgacgaguacauguacggcggcggcugcgccgagaccgacgagggccacgcccacuggcuggaggcccgcaugcugcuggacaacaucuaccugcaggacggccugaucgccagccuguaccgccccgaggccgacaagguggccgccaucgagggcgaguucaagcugcgcaccgagcagcgcaagaccuucguggagcugaugaagcgcggcgaccugcccguguggcuggccuaccagguggccagcgccggcaucaccuacaccgaccgccgcuggugcuucgacggcaccaccaacaacaccaucauggaggacagcgugcccgccgagguguggaccaaguacggcgagaagcgcgugcugaagccccgcuggauggacgcccgcgugugcagcgaccacgccgcccugaagagcuucaaggaguucgccgccggcaagcgcggcgccgcccugggcgugauggaggcccugggcacccugcccggccacaugaccgagcgcuuccaggaggccaucgacaaccuggccgugcugaugcgcgccgagaccggcagccgccccuacaaggccgccgccgcccagcugcccgagacccuggagaccaucaugcugcugggccugcugggcaccgugagccugggcaucuucuucgugcugaugcgcaacaagggcaucggcaagaugggcuucggcauggugacccugggcgccagcgccuggcugauguggcugagcgagaucgagcccgcccgcaucgccugcgugcugaucgugguguuccugcugcugguggugcugauccccgagcccgagaagcagcgcagcccccaggacaaccagauggccaucaucaucaugguggccgugggccugcugggccugaucaccgccaacgagcugggcuggcuggagcgcaccaagaacgacaucgcccaccugaugggccgccgcgaggagggcgccaccaugggcuucagcauggacaucgaccugcgccccgccagcgccugggccaucuacgccgcccugaccacccugaucacccccgccgugcagcacgccgugaccaccagcuacaacaacuacagccugauggccauggccacccaggccggcgugcuguucggcaugggcaagggcaugcccuucaugcacggcgaccugggcgugccccugcugaugaugggcugcuacagccagcugaccccccugacccugaucguggccaucauccugcugguggcccacuacauguaccugauccccggccugcaggccgccgccgcccgcgccgcccagaagcgcaccgccgccggcaucaugaagaaccccgugguggacggcaucguggugaccgacaucgacaccaugaccaucgacccccagguggagaagaagaugggccaggugcugcugaucgccguggccaucagcagcgccgugcugcugcgcaccgccuggggcuggggcgaggccggcgcccugaucaccgccgccaccagcacccugugggagggcagccccaacaaguacuggaacagcagcaccgccaccagccugugcaacaucuuccgcggcagcuaccuggccggcgccagccugaucuacaccgugacccgcaacgccggccuggugaagcgccgcggcggcggcaccggcgagacccugggcgagaaguggaaggcccgccugaaccagaugagcgcccuggaguucuacagcuacaagaagagcggcaucaccgaggugugccgcgaggaggcccgccgcgcccugaaggacggcguggccaccggcggccacgccgugagccgcggcagcgccaagauccgcuggcuggaggagcgcggcuaccugcagcccuacggcaaggugguggaccugggcugcggccgcggcggcuggagcuacuacgccgccaccauccgcaaggugcaggaggugcgcggcuacaccaagggcggccccggccacgaggagcccaugcuggugcagagcuacggcuggaacaucgugcgccugaagagcggcguggacguguuccacauggccgccgagcccugcgacacccugcugugcgacaucggcgagagcagcagcagccccgagguggaggagacccgcacccugcgcgugcugagcauggugggcgacuggcuggagaagcgccccggcgccuucugcaucaaggugcugugccccuacaccagcaccaugauggagaccauggagcgccugcagcgccgccacggcggcggccuggugcgcgugccccugugccgcaacagcacccacgagauguacugggugagcggcgccaagagcaacaucaucaagagcgugagcaccaccagccagcugcugcugggccgcauggacggcccccgccgccccgugaaguacgaggaggacgugaaccugggcagcggcacccgcgccguggccagcugcgccgaggcccccaacaugaagaucaucggccgccgcaucgagcgcauccgcaacgagcacgccgagaccugguuccuggacgagaaccaccccuaccgcaccugggccuaccacggcagcuacgaggcccccacccagggcagcgccagcagccuggugaacggcguggugcgccugcugagcaagcccugggacguggugaccggcgugaccggcaucgccaugaccgacaccacccccuacggccagcagcgcguguucaaggagaagguggacacccgcgugcccgacccccaggagggcacccgccaggugaugaacaucgugagcagcuggcuguggaaggagcugggcaagcgcaagcgcccccgcgugugcaccaaggaggaguucaucaacaaggugcgcagcaacgccgcccugggcgccaucuucgaggaggagaaggaguggaagaccgccguggaggccgugaacgacccccgcuucugggcccugguggaccgcgagcgcgagcaccaccugcgcggcgagugccacagcugcguguacaacaugaugggcaagcgcgagaagaagcagggcgaguucggcaaggccaagggcagccgcgccaucugguacauguggcugggcgcccgcuuccuggaguucgaggcccugggcuuccugaacgaggaccacuggaugggccgcgagaacagcggcggcggcguggagggccugggccugcagcgccugggcuacauccuggaggagaugaaccgcgcccccggcggcaagauguacgccgacgacaccgccggcugggacacccgcaucagcaaguucgaccuggagaacgaggcccugaucaccaaccagauggaggagggccaccgcacccuggcccuggccgugaucaaguacaccuaccagaacaagguggugaaggugcugcgccccgccgagggcggcaagaccgugauggacaucaucagccgccaggaccagcgcggcagcggccagguggugaccuacgcccugaacaccuucaccaaccugguggugcagcugauccgcaacauggaggccgaggaggugcuggagaugcaggaccuguggcugcugcgcaagcccgagaaggugacccgcuggcugcagagcaacggcugggaccgccugaagcgcauggccgugagcggcgacgacugcguggugaagcccaucgacgaccgcuucgcccacgcccugcgcuuccugaacgacaugggcaaggugcgcaaggacacccaggaguggaagcccagcaccggcuggagcaacugggaggaggugcccuucugcagccaccacuucaacaagcuguaccugaaggacggccgcagcaucguggugcccugccgccaccaggacgagcugaucggccgcgcccgcgugagccccggcgccggcuggagcauccgcgagaccgccugccuggccaagagcuacgcccagauguggcagcugcuguacuuccaccgccgcgaccugcgccugauggccaacgccaucugcagcgccgugcccguggacugggugcccaccggccgcaccaccuggagcauccacggcaagggcgaguggaugaccaccgaggacaugcugaugguguggaaccgcguguggaucgaggagaacgaccacauggaggacaagacccccgugaccaaguggaccgacauccccuaccugggcaagcgcgaggaccuguggugcggcagccugaucggccaccgcccccgcaccaccugggccgagaacaucaaggacaccgugaacauggugcgccgcaucaucggcgacgaggagaaguacauggacuaccugagcacccaggugcgcuaccugggcgaggagggcagcacccccggcgugcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 339 - RNA, 2512 nt, Artificial Sequence
  ZIKV (strain MR 766) Polyprotein(93-800) mRNA Design 2 opimized
ggggcgcugccuacggagguggcagccaucuccuucucggcaucaagcuuaccaugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 340 - RNA, 2512 nt, Artificial Sequence
  ZIKV (strain MR 766) Polyprotein(93-800) mRNA Design 2 opimized
ggggcgcugccuacggagguggcagccaucuccuucucggcaucaagcuuaccaugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 341 - RNA, 1729 nt, Artificial Sequence
  ZIKV (strain MR 766) Polyprotein(273-719) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 342 - RNA, 1729 nt, Artificial Sequence
  ZIKV (strain MR 766) Polyprotein(273-719) mRNA Design 2 opimized
ggggcgcugccuacggagguggcagccaucuccuucucggcaucaagcuuaccaugagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 343 - protein, 18 aa, Artificial Sequence
  ZIKV (strain ZikaSPH2015) SS
GADTSVGIVGLLLTTAMA

SEQ ID NO: 344 - protein, 18 aa, Artificial Sequence
  ZIKV (isolate Z1106033) SS
GADTSVGIVGLLLTTAMA

SEQ ID NO: 345 - protein, 18 aa, Artificial Sequence
  ZIKV (strain MR 766) SS
GADTSIGIIGLLLTTAMA

SEQ ID NO: 346 - RNA, 54 nt, Artificial Sequence
  ZIKV (strain ZikaSPH2015) SS
ggcgcagauacuagugucggaauuguuggccuccugcugaccacagcuauggca

SEQ ID NO: 347 - RNA, 54 nt, Artificial Sequence; identical to SEQ ID NO: 346
  ZIKV (isolate Z1106033) SS

SEQ ID NO: 348 - RNA, 54 nt, Artificial Sequence
  ZIKV (strain MR 766) SS
ggcgcagacaccagcaucggaaucauuggccuccugcugacuacagccauggca

SEQ ID NO: 349 - RNA, 54 nt, Artificial Sequence
  ZIKV (strain ZikaSPH2015) SS
ggcgccgacaccagcguggggaucgugggccuccugcugacgaccgccauggcg

SEQ ID NO: 350 - RNA, 54 nt, Artificial Sequence; identical to SEQ ID NO: 349
  ZIKV (isolate Z1106033) SS

SEQ ID NO: 351 - RNA, 54 nt, Artificial Sequence
  ZIKV (strain MR 766) SS
ggcgccgacaccagcaucgggaucaucggccugcugcucacgaccgccauggcg

SEQ ID NO: 352 - RNA, 54 nt, Artificial Sequence
  ZIKV (strain ZikaSPH2015) SS
ggcgccgauaccagcgugggcauugugggccugcugcugacaacagccauggcc

SEQ ID NO: 353 - RNA, 54 nt, Artificial Sequence; identical to SEQ ID NO: 352
  ZIKV (isolate Z1106033) SS

SEQ ID NO: 354 - RNA, 54 nt, Artificial Sequence
  ZIKV (strain MR 766) SS
ggcgccgauaccagcaucggcaucaucggccugcugcugaccacagccauggcc

SEQ ID NO: 355 - RNA, 54 nt, Artificial Sequence
  ZIKV (strain ZikaSPH2015) SS
ggcgccgacaccagcgugggcaucgugggccugcugcugacaaccgccauggcc

SEQ ID NO: 356 - RNA, 54 nt, Artificial Sequence; identical to SEQ ID NO: 355
  ZIKV (isolate Z1106033) SS

SEQ ID NO: 357 - RNA, 54 nt, Artificial Sequence
  ZIKV (strain MR 766) SS
ggcgccgacaccagcaucggcaucaucggccugcugcugaccaccgccauggcc

SEQ ID NO: 358 - RNA, 54 nt, Artificial Sequence
  ZIKV (strain ZikaSPH2015) SS
ggcgccgacaccagcgugggcaucgugggccugcugcugaccaccgccauggcc

SEQ ID NO: 359 - RNA, 54 nt, Artificial Sequence; identical to SEQ ID NO: 358
  ZIKV (isolate Z1106033) SS

SEQ ID NO: 360 - RNA, 54 nt, Artificial Sequence; identical to SEQ ID NO: 357
  ZIKV (strain MR 766) SS

SEQ ID NO: 361 - protein, 12 aa, Artificial Sequence
  ZIKV (strain ZikaSPH2015) X
RIINARKEKKRR

SEQ ID NO: 362 - protein, 12 aa, Artificial Sequence
  ZIKV (isolate Z1106033) X
RIINARKEKKRR

SEQ ID NO: 363 - protein, 12 aa, Artificial Sequence
  ZIKV (strain MR 766) X
RIINARKERKRR

SEQ ID NO: 364 - RNA, 36 nt, Artificial Sequence
  ZIKV (strain ZikaSPH2015) X
agaauaaucaaugcuaggaaggagaagaagagacgg

SEQ ID NO: 365 - RNA, 36 nt, Artificial Sequence
  ZIKV (isolate Z1106033) X
agaauaaucaaugcuaggaaggagaagaagagacga

SEQ ID NO: 366 - RNA, 36 nt, Artificial Sequence
  ZIKV (strain MR 766) X
agaauaaucaaugcuaggaaagagaggaagagacgu

SEQ ID NO: 367 - RNA, 36 nt, Artificial Sequence
  ZIKV (strain ZikaSPH2015) X
cggaucaucaacgcccgcaaggagaagaagcggcgc

SEQ ID NO: 368 - RNA, 36 nt, Artificial Sequence; identical to SEQ ID NO: 367
  ZIKV (isolate Z1106033) X

SEQ ID NO: 369 - RNA, 36 nt, Artificial Sequence
  ZIKV (strain MR 766) X
cggaucaucaacgcccgcaaggagcggaagcgccgg

SEQ ID NO: 370 - RNA, 36 nt, Artificial Sequence
  ZIKV (strain ZikaSPH2015) X
cggaucaucaacgcccggaaagagaagaagcgcaga

SEQ ID NO: 371 - RNA, 36 nt, Artificial Sequence; identical to SEQ ID NO: 370
  ZIKV (isolate Z1106033) X

SEQ ID NO: 372 - RNA, 36 nt, Artificial Sequence
  ZIKV (strain MR 766) X
cggaucaucaacgcccggaaagagcggaagcggaga

SEQ ID NO: 373 - RNA, 36 nt, Artificial Sequence; identical to SEQ ID NO: 370
  ZIKV (strain ZikaSPH2015) X

SEQ ID NO: 374 - RNA, 36 nt, Artificial Sequence; identical to SEQ ID NO: 370
  ZIKV (isolate Z1106033) X

SEQ ID NO: 375 - RNA, 36 nt, Artificial Sequence; identical to SEQ ID NO: 372
  ZIKV (strain MR 766) X

SEQ ID NO: 376 - RNA, 36 nt, Artificial Sequence
  ZIKV (strain ZikaSPH2015) X
cgcaucaucaacgcccgcaaggagaagaagcgccgc

SEQ ID NO: 377 - RNA, 36 nt, Artificial Sequence; identical to SEQ ID NO: 376
  ZIKV (isolate Z1106033) X

SEQ ID NO: 378 - RNA, 36 nt, Artificial Sequence
  ZIKV (strain MR 766) X
cgcaucaucaacgcccgcaaggagcgcaagcgccgc

SEQ ID NO: 379 - protein, 10 aa, Artificial Sequence
  ZIKV (strain ZikaSPH2015) XX
DVGCSVDFSK

SEQ ID NO: 380 - protein, 10 aa, Artificial Sequence
  ZIKV (isolate Z1106033) XX
DVGCSVDFSK

SEQ ID NO: 381 - protein, 10 aa, Artificial Sequence
  ZIKV (strain MR 766) XX
DVGCSVDFSK

SEQ ID NO: 382 - RNA, 30 nt, Artificial Sequence
  ZIKV (strain ZikaSPH2015) XX
gauguggggugcucgguggacuucucaaag

SEQ ID NO: 383 - RNA, 30 nt, Artificial Sequence; identical to SEQ ID NO: 382
  ZIKV (isolate Z1106033) XX

SEQ ID NO: 384 - RNA, 30 nt, Artificial Sequence
  ZIKV (strain MR 766) XX
gacguggggugcucaguggacuucucaaaa

SEQ ID NO: 385 - RNA, 30 nt, Artificial Sequence
  ZIKV (strain ZikaSPH2015) XX
gacguggggugcuccgucgacuucagcaag

SEQ ID NO: 386 - RNA, 30 nt, Artificial Sequence
  ZIKV (isolate Z1106033) XX
gacgucgggugcuccguggacuucagcaag

SEQ ID NO: 387 - RNA, 30 nt, Artificial Sequence
  ZIKV (strain MR 766) XX
gacguggggugcuccguggacuucagcaag

SEQ ID NO: 388 - RNA, 30 nt, Artificial Sequence
  ZIKV (strain ZikaSPH2015) XX
gacgugggcugcagcguggacuucagcaaa

SEQ ID NO: 389 - RNA, 30 nt, Artificial Sequence; identical to SEQ ID NO: 388
  ZIKV (isolate Z1106033) XX

SEQ ID NO: 390 - RNA, 30 nt, Artificial Sequence
  ZIKV (strain MR 766) XX
gaugugggcuguagcguggacuucagcaaa

SEQ ID NO: 391 - RNA, 30 nt, Artificial Sequence
  ZIKV (strain ZikaSPH2015) XX
gacgugggcugcagcguggacuucuccaaa

SEQ ID NO: 392 - RNA, 30 nt, Artificial Sequence; identical to SEQ ID NO: 391
  ZIKV (isolate Z1106033) XX

SEQ ID NO: 393 - RNA, 30 nt, Artificial Sequence; identical to SEQ ID NO: 391
  ZIKV (strain MR 766) XX

SEQ ID NO: 394 - RNA, 30 nt, Artificial Sequence
  ZIKV (strain ZikaSPH2015) XX
gacgugggcugcagcguggacuucagcaag

SEQ ID NO: 395 - RNA, 30 nt, Artificial Sequence; identical to SEQ ID NO: 394
  ZIKV (isolate Z1106033) XX

SEQ ID NO: 396 - RNA, 30 nt, Artificial Sequence; identical to SEQ ID NO: 394
  ZIKV (strain MR 766) XX

SEQ ID NO: 397 - protein, 794 aa, Artificial Sequence
  ZIKV (strain ZikaSPH2015) C-prME
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 398 - protein, 794 aa, Artificial Sequence
  ZIKV (isolate Z1106033) C-prME
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 399 - protein, 790 aa, Artificial Sequence
  ZIKV (strain MR 766) C-prME
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 400 - RNA, 2382 nt, Artificial Sequence
  ZIKV (strain ZikaSPH2015) C-prME
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 401 - RNA, 2382 nt, Artificial Sequence
  ZIKV (isolate Z1106033) C-prME
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 402 - RNA, 2370 nt, Artificial Sequence
  ZIKV (strain MR 766) C-prME
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 403 - RNA, 2382 nt, Artificial Sequence
  ZIKV (strain ZikaSPH2015) C-prME
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 404 - RNA, 2382 nt, Artificial Sequence
  ZIKV (isolate Z1106033) C-prME
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 405 - RNA, 2370 nt, Artificial Sequence
  ZIKV (strain MR 766) C-prME
augaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 406 - RNA, 2382 nt, Artificial Sequence
  ZIKV (strain ZikaSPH2015) C-prME
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 407 - RNA, 2382 nt, Artificial Sequence
  ZIKV (isolate Z1106033) C-prME
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 408 - RNA, 2370 nt, Artificial Sequence
  ZIKV (strain MR 766) C-prME
augaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 409 - protein, 1146 aa, Artificial Sequence
  ZIKV (strain ZikaSPH2015) C-prME-NS1
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 410 - protein, 1146 aa, Artificial Sequence
  ZIKV (isolate Z1106033) C-prME-NS1
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 411 - protein, 1142 aa, Artificial Sequence
  ZIKV (strain MR 766) C-prME-NS1
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTA

SEQ ID NO: 412 - RNA, 3438 nt, Artificial Sequence
  ZIKV (strain ZikaSPH2015) C-prME-NS1
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 413 - RNA, 3438 nt, Artificial Sequence
  ZIKV (isolate Z1106033) C-prME-NS1
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 414 - RNA, 3426 nt, Artificial Sequence
  ZIKV (strain MR 766) C-prME-NS1
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcg

SEQ ID NO: 415 - RNA, 3438 nt, Artificial Sequence
  ZIKV (strain ZikaSPH2015) C-prME-NS1
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcg

SEQ ID NO: 416 - RNA, 3438 nt, Artificial Sequence
  ZIKV (isolate Z1106033) C-prME-NS1
augaagaaccccaagaagaagagcggcggguuccgcaucgugaacaugcugaagcggggcgucgcccgcguguccccguucgggggccucaagcggcugcccgccgggcugcuccugggccacggccccauccgcauggugcuggcgauccucgccuuccugcgguucaccgccaucaagcccagccuggggcucaucaaccgcuggggcuccgucgggaagaaggaggccauggagaucaucaagaaguucaagaaggaccuggccgcgaugcugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgcc

SEQ ID NO: 417 - RNA, 3426 nt, Artificial Sequence
  ZIKV (strain MR 766) C-prME-NS1
augaagaaccccaaggaggagauccgccggauccgcaucgugaacaugcugaagcggggcgucgcccgcgugaacccgcucgggggccugaagcggcugcccgccgggcuccugcugggccacgggcccauccgcauggugcucgcgauccuggccuuccugcgguucaccgccaucaagcccagccucggccugaucaaccgcuggggcuccgucgggaagaaggaggccauggagaucaucaagaaguucaagaaggaccuggccgcgaugcuccggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgcc

SEQ ID NO: 418 - RNA, 3438 nt, Artificial Sequence
  ZIKV (strain ZikaSPH2015) C-prME-NS1
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 419 - RNA, 3438 nt, Artificial Sequence
  ZIKV (isolate Z1106033) C-prME-NS1
augaagaaccccaagaagaagagcggcggcuuccgcaucgugaacaugcugaagcgcggcguggcccgcgugagccccuucggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagaagaagcgccgcggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 420 - RNA, 3426 nt, Artificial Sequence
  ZIKV (strain MR 766) C-prME-NS1
augaagaaccccaaggaggagauccgccgcauccgcaucgugaacaugcugaagcgcggcguggcccgcgugaacccccugggcggccugaagcgccugcccgccggccugcugcugggccacggccccauccgcauggugcuggccauccuggccuuccugcgcuucaccgccaucaagcccagccugggccugaucaaccgcuggggcagcgugggcaagaaggaggccauggagaucaucaagaaguucaagaaggaccuggccgccaugcugcgcaucaucaacgcccgcaaggagcgcaagcgccgcggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 421 - protein, 690 aa, Artificial Sequence
  ZIKV (strain ZikaSPH2015) SS-prME
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 422 - protein, 690 aa, Artificial Sequence
  ZIKV (isolate Z1106033) SS-prME
GADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 423 - protein, 686 aa, Artificial Sequence
  ZIKV (strain MR 766) SS-prME
GADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 424 - RNA, 2070 nt, Artificial Sequence
  ZIKV (strain ZikaSPH2015) SS-prME
ggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 425 - RNA, 2070 nt, Artificial Sequence
  ZIKV (isolate Z1106033) SS-prME
ggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 426 - RNA, 2058 nt, Artificial Sequence
  ZIKV (strain MR 766) SS-prME
ggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 427 - RNA, 2070 nt, Artificial Sequence
  ZIKV (strain ZikaSPH2015) SS-prME
ggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 428 - RNA, 2070 nt, Artificial Sequence
  ZIKV (isolate Z1106033) SS-prME
ggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 429 - RNA, 2058 nt, Artificial Sequence
  ZIKV (strain MR 766) SS-prME
ggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 430 - RNA, 2070 nt, Artificial Sequence
  ZIKV (strain ZikaSPH2015) SS-prME
ggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 431 - RNA, 2070 nt, Artificial Sequence
  ZIKV (isolate Z1106033) SS-prME
ggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 432 - RNA, 2058 nt, Artificial Sequence
  ZIKV (strain MR 766) SS-prME
ggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 433 - protein, 1042 aa, Artificial Sequence
  ZIKV (strain ZikaSPH2015) SS-prME-NS1
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 434 - protein, 1042 aa, Artificial Sequence
  ZIKV (isolate Z1106033) SS-prME-NS1
GADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 435 - protein, 1038 aa, Artificial Sequence
  ZIKV (strain MR 766) SS-prME-NS1
GADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTA

SEQ ID NO: 436 - RNA, 3126 nt, Artificial Sequence
  ZIKV (strain ZikaSPH2015) SS-prME-NS1
ggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 437 - RNA, 3126 nt, Artificial Sequence
  ZIKV (isolate Z1106033) SS-prME-NS1
ggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagaaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 438 - RNA, 3114 nt, Artificial Sequence
  ZIKV (strain MR 766) SS-prME-NS1
ggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaaaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcg

SEQ ID NO: 439 - RNA, 3126 nt, Artificial Sequence
  ZIKV (strain ZikaSPH2015) SS-prME-NS1
ggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagaaggagacccgcugcgggacgggcguguucguguacaacgacgucgaggccuggcgggaccgcuacaaguaccaccccgacuccccgcgccggcuggccgccgcggugaagcaggccugggaggacgggaucugcggcaucagcuccgugagccgcauggagaacaucauguggcggagcgucgagggggagcugaacgccauccucgaggagaacggcgugcagcugaccguggucgugggcuccgugaagaacccgauguggcgcgggccccagcggcugcccgucccggugaacgagcucccccacggcuggaaggccugggggaagagccacuucgugcgcgcggccaagaccaacaacuccuucgucguggacggcgacacccugaaggagugcccccugaagcaccgggccuggaacagcuuccucguggaggaccacggguucggcgucuuccacacguccguguggcugaaggugcgcgaggacuacagccuggagugcgaccccgccgucaucggcaccgccgugaaggggaaggaggcggugcacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaagguccacguggaggagaccugcgggacccgcggccccagccugcgguccaccacggccagcgggcgcgucaucgaggaguggugcugccgggagugcaccaugcccccgcucuccuuccgcgccaaggacggcugcugguacggcauggagauccggccgcgcaaggagcccgagagcaaccuggugcgguccauggugaccgcg

SEQ ID NO: 440 - RNA, 3126 nt, Artificial Sequence
  ZIKV (isolate Z1106033) SS-prME-NS1
ggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagaaggagacccgcugcgggacgggcguguucgucuacaacgacguggaggccuggcgggaccgcuacaaguaccaccccgacuccccgcgccggcuggccgcggccgugaagcaggccugggaggacgggaucugcggcaucagcuccgucagccgcauggagaacaucauguggcggagcguggagggggagcugaacgccauccucgaggagaacggcgugcagcugaccgucguggugggcuccgucaagaacccgauguggcgcgggccccagcggcugcccgugccggugaacgagcucccccacggcuggaaggcgugggggaagagcuacuucguccgcgccgccaagaccaacaacuccuucgugguggacggcgacacccugaaggagugcccccugaagcaccgggccuggaacagcuuccucgucgaggaccacggguucggcguguuccacacguccguguggcugaagguccgcgaggacuacagccuggagugcgaccccgccgugaucggcaccgcggugaaggggaaggaggccguccacuccgaccucggcuacuggaucgagagcgagaagaacgacaccuggcggcugaagcgcgcccaccugaucgagaugaagaccugcgaguggccgaagucccacacgcucuggaccgacgggaucgaggagagcgaccugaucauccccaagucccuggccggcccccucagccaccacaacacccgggagggguaccgcacccagaugaagggccccuggcacuccgaggagcuggagauccgguucgaggagugcccgggcacgaaggugcacgucgaggagaccugcgggacccgcggccccagccugcgguccaccacggccagcgggcgcgugaucgaggaguggugcugccgggagugcaccaugccgccccucuccuuccgcgcgaaggacggcugcugguacggcauggagauccggccgcgcaaggagcccgagagcaaccuggugcgguccauggucaccgcc

SEQ ID NO: 441 - RNA, 3114 nt, Artificial Sequence
  ZIKV (strain MR 766) SS-prME-NS1
ggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagaaggagacgcgcugcgggaccggcgucuucaucuacaacgacguggaggccuggcgcgaccgguacaaguaccaccccgacuccccgcgccggcucgccgcggccgugaagcaggccugggaggaggggaucugcggcaucagcuccgucagccgcauggagaacaucauguggaaguccguggagggggagcugaacgccauccuggaggagaacggcgugcagcucaccgucgugguggggagcgucaagaaccccauguggcggggcccgcagcgccugcccgugcccgugaacgagcugccgcacggcuggaaggccugggggaagagcuacuucguccgggcggccaagaccaacaacuccuucgugguggacggcgacacgcucaaggagugcccccuggagcaccgcgccuggaacagcuuccuggucgaggaccacggguucggcguguuccacaccuccguguggcucaagguccgggaggacuacagccuggagugcgaccccgccgugaucgggaccgcggucaagggccgcgaggccgcccacuccgaccugggcuacuggaucgagagcgagaagaacgacaccuggcggcucaagcgcgcccaccugaucgagaugaagacgugcgaguggcccaagucccacacccuguggaccgacgggguggaggagagcgaccucaucaucccgaagucccuggccggcccccugagccaccacaacacccgggagggguaccgcacccaggugaagggccccuggcacuccgaggagcucgagauccgguucgaggagugccccgggaccaaggucuacguggaggagaccugcggcacccgcggcccgagccugcgguccacgaccgcgagcgggcgcgugaucgaggaguggugcugccgggagugcaccaugccgccccuguccuuccgcgccaaggacggcugcugguacgggauggagauccggccccgcaaggagccggagagcaaccucguccgcuccauggugaccgcc

SEQ ID NO: 442 - RNA, 3126 nt, Artificial Sequence
  ZIKV (strain ZikaSPH2015) SS-prME-NS1
ggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagccacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 443 - RNA, 3126 nt, Artificial Sequence
  ZIKV (isolate Z1106033) SS-prME-NS1
ggcgccgacaccagcgugggcaucgugggccugcugcugaccaccgccauggccgccgaggugacccgccgcggcagcgccuacuacauguaccuggaccgcaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugauccgcguggagaacuggaucuuccgcaaccccggcuucgcccuggccgccgccgccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagaaggagacccgcugcggcaccggcguguucguguacaacgacguggaggccuggcgcgaccgcuacaaguaccaccccgacagcccccgccgccuggccgccgccgugaagcaggccugggaggacggcaucugcggcaucagcagcgugagccgcauggagaacaucauguggcgcagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccugaagcaccgcgccuggaacagcuuccugguggaggaccacggcuucggcguguuccacaccagcguguggcugaaggugcgcgaggacuacagccuggagugcgaccccgccgugaucggcaccgccgugaagggcaaggaggccgugcacagcgaccugggcuacuggaucgagagcgagaagaacgacaccuggcgccugaagcgcgcccaccugaucgagaugaagaccugcgaguggcccaagagccacacccuguggaccgacggcaucgaggagagcgaccugaucauccccaagagccuggccggcccccugagccaccacaacacccgcgagggcuaccgcacccagaugaagggccccuggcacagcgaggagcuggagauccgcuucgaggagugccccggcaccaaggugcacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 444 - RNA, 3114 nt, Artificial Sequence
  ZIKV (strain MR 766) SS-prME-NS1
ggcgccgacaccagcaucggcaucaucggccugcugcugaccaccgccauggccgccgagaucacccgccgcggcagcgccuacuacauguaccuggaccgcagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccgccgcagccgccgcgccgugacccugcccagccacagcacccgcaagcugcagacccgcagccagaccuggcuggagagccgcgaguacaccaagcaccugaucaagguggagaacuggaucuuccgcaaccccggcuucgcccugguggccguggccaucgccuggcugcugggcagcagcaccagccagaaggugaucuaccuggugaugauccugcugaucgcccccgccuacagcauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagaaggagacccgcugcggcaccggcguguucaucuacaacgacguggaggccuggcgcgaccgcuacaaguaccaccccgacagcccccgccgccuggccgccgccgugaagcaggccugggaggagggcaucugcggcaucagcagcgugagccgcauggagaacaucauguggaagagcguggagggcgagcugaacgccauccuggaggagaacggcgugcagcugaccgugguggugggcagcgugaagaaccccauguggcgcggcccccagcgccugcccgugcccgugaacgagcugccccacggcuggaaggccuggggcaagagcuacuucgugcgcgccgccaagaccaacaacagcuucgugguggacggcgacacccugaaggagugcccccuggagcaccgcgccuggaacagcuuccugguggaggaccacggcuucggcguguuccacaccagcguguggcugaaggugcgcgaggacuacagccuggagugcgaccccgccgugaucggcaccgccgugaagggccgcgaggccgcccacagcgaccugggcuacuggaucgagagcgagaagaacgacaccuggcgccugaagcgcgcccaccugaucgagaugaagaccugcgaguggcccaagagccacacccuguggaccgacggcguggaggagagcgaccugaucauccccaagagccuggccggcccccugagccaccacaacacccgcgagggcuaccgcacccaggugaagggccccuggcacagcgaggagcuggagauccgcuucgaggagugccccggcaccaagguguacguggaggagaccugcggcacccgcggccccagccugcgcagcaccaccgccagcggccgcgugaucgaggaguggugcugccgcgagugcaccaugcccccccugagcuuccgcgccaaggacggcugcugguacggcauggagauccgcccccgcaaggagcccgagagcaaccuggugcgcagcauggugaccgcc

SEQ ID NO: 445 - protein, 544 aa, Artificial Sequence
  ZIKV (strain ZikaSPH2015) 10aa-SS-E-10aa
RIINARKEKKRRGADTSVGIVGLLLTTAMAIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 446 - protein, 544 aa, Artificial Sequence
  ZIKV (isolate Z1106033) 10aa-SS-E-10aa
RIINARKEKKRRGADTSVGIVGLLLTTAMAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSK

SEQ ID NO: 447 - protein, 540 aa, Artificial Sequence
  ZIKV (strain MR 766) 10aa-SS-E-10aa
RIINARKERKRRGADTSIGIIGLLLTTAMAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 448 - RNA, 1632 nt, Artificial Sequence
  ZIKV (strain ZikaSPH2015) 10aa-SS-E-10aa
agaauaaucaaugcuaggaaggagaagaagagacggggcgcagauacuagugucggaauuguuggccuccugcugaccacagcuauggcaaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 449 - RNA, 1632 nt, Artificial Sequence
  ZIKV (isolate Z1106033) 10aa-SS-E-10aa
agaauaaucaaugcuaggaaggagaagaagagacgaggcgcagauacuagugucggaauuguuggccuccugcugaccacagcuauggcaaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaag

SEQ ID NO: 450 - RNA, 1620 nt, Artificial Sequence
  ZIKV (strain MR 766) 10aa-SS-E-10aa
agaauaaucaaugcuaggaaagagaggaagagacguggcgcagacaccagcaucggaaucauuggccuccugcugacuacagccauggcaaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaa

SEQ ID NO: 451 - RNA, 1632 nt, Artificial Sequence
  ZIKV (strain ZikaSPH2015) 10aa-SS-E-10aa
cggaucaucaacgcccgcaaggagaagaagcggcgcggcgccgacaccagcguggggaucgugggccuccugcugacgaccgccauggcgauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 452 - RNA, 1632 nt, Artificial Sequence
  ZIKV (isolate Z1106033) 10aa-SS-E-10aa
cggaucaucaacgcccgcaaggagaagaagcggcgcggcgccgacaccagcguggggaucgugggccuccugcugacgaccgccauggcgauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaag

SEQ ID NO: 453 - RNA, 1620 nt, Artificial Sequence
  ZIKV (strain MR 766) 10aa-SS-E-10aa
cggaucaucaacgcccgcaaggagcggaagcgccggggcgccgacaccagcaucgggaucaucggccugcugcucacgaccgccauggcgauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaag

SEQ ID NO: 454 - RNA, 1632 nt, Artificial Sequence
  ZIKV (strain ZikaSPH2015) 10aa-SS-E-10aa
cgcaucaucaacgcccgcaaggagaagaagcgccgcggcgccgacaccagcgugggcaucgugggccugcugcugaccaccgccauggccauccgcugcaucggcgugagcaaccgcgacuucguggagggcaugagcggcggcaccuggguggacaucgugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 455 - RNA, 1632 nt, Artificial Sequence
  ZIKV (isolate Z1106033) 10aa-SS-E-10aa
cgcaucaucaacgcccgcaaggagaagaagcgccgcggcgccgacaccagcgugggcaucgugggccugcugcugaccaccgccauggccauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucgccugcagcaagaagaugaccggcaagagcauccagcccgagaaccuggaguaccgcaucaugcugagcgugcacggcagccagcacagcggcaugaucgugaacgacaccggccacgagaccgacgagaaccgcgccaagguggagaucacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccugagcagcggccaccugaagugccgccugaagauggacaagcugcgccugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgagaagaagaucacccaccacuggcaccgcagcggcagcaccaucggcaaggccuucgaggccaccgugcgcggcgccaagcgcauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaag

SEQ ID NO: 456 - RNA, 1620 nt, Artificial Sequence
  ZIKV (strain MR 766) 10aa-SS-E-10aa
cgcaucaucaacgcccgcaaggagcgcaagcgccgcggcgccgacaccagcaucggcaucaucggccugcugcugaccaccgccauggccauccgcugcaucggcgugagcaaccgcgacuucguggagggcaugagcggcggcaccuggguggacguggugcuggagcacggcggcugcgugaccgugauggcccaggacaagcccaccguggacaucgagcuggugaccaccaccgugagcaacauggccgaggugcgcagcuacugcuacgaggccagcaucagcgacauggccagcgacagccgcugccccacccagggcgaggccuaccuggacaagcagagcgacacccaguacgugugcaagcgcacccugguggaccgcggcuggggcaacggcugcggccuguucggcaagggcagccuggugaccugcgccaaguucaccugcagcaagaagaugaccggcaagagcauccagcccgagaaccuggaguaccgcaucaugcugagcgugcacggcagccagcacagcggcaugaucggcuacgagaccgacgaggaccgcgccaagguggaggugacccccaacagcccccgcgccgaggccacccugggcggcuucggcagccugggccuggacugcgagccccgcaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagcgccagaccgugguggugcugggcagccaggagggcgccgugcacaccgcccuggccggcgcccuggaggccgagauggacggcgccaagggccgccuguucagcggccaccugaagugccgccugaagauggacaagcugcgccugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggccgccugaucaccgccaaccccgugaucaccgagagcaccgagaacagcaagaugaugcuggagcuggacccccccuucggcgacagcuacaucgugaucggcgugggcgacaagaagaucacccaccacuggcaccgcagcggcagcaccaucggcaaggccuucgaggccaccgugcgcggcgccaagcgcauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 457 - DNA, 42 bp, Artificial Sequence
  5-UTR of human ribosomal protein Large 32 lacking the 5 terminal oligopyrimidine tract
ggcgctgcctacggaggtggcagccatctccttctcggcatc

SEQ ID NO: 458 - RNA, 42 nt, Artificial Sequence
  5-UTR of human ribosomal protein Large 32 lacking the 5 terminal oligopyrimidine tract mRNA
ggcgcugccuacggagguggcagccaucuccuucucggcauc

SEQ ID NO: 459 - DNA, 75 bp, Artificial Sequence
  5-UTR of human mitochondrial ATP synthase subunit alpha lacking the 5 terminal oligopyrimidine tract
gcggctcggccattttgtcccagtcagtccggaggctgcggctgcagaagtaccgcctgcggagtaactgcaaag

SEQ ID NO: 460 - RNA, 75 nt, Artificial Sequence
  5-UTR of human mitochondrial ATP synthase subunit alpha lacking the 5 terminal oligopyrimidine tract mRNA
gcggcucggccauuuugucccagucaguccggaggcugcggcugcagaaguaccgccugcggaguaacugcaaag

SEQ ID NO: 461 - DNA, 46 bp, Artificial Sequence
  5-UTR of human ribosomal protein Large 32 lacking the 5 terminal oligopyrimidine tract
gagaggcgctgcctacggaggtggcagccatctccttctcggcatc

SEQ ID NO: 462 - RNA, 46 nt, Artificial Sequence
  5-UTR of human ribosomal protein Large 32 lacking the 5 terminal oligopyrimidine tract mRNA
gagaggcgcugccuacggagguggcagccaucuccuucucggcauc

SEQ ID NO: 463 - DNA, 62 bp, Artificial Sequence
  5-UTR of human peroxisomal multifunctional enzyme type 2 lacking the 5 terminal oligopyrimidine tract
gtcccgcagtcggcgtccagcggctctgcttgttcgtgtgtgtgtcgttgcaggccttattc

SEQ ID NO: 464 - RNA, 62 nt, Artificial Sequence
  5-UTR of human peroxisomal multifunctional enzyme type 2 lacking the 5 terminal oligopyrimidine tract mRNA
gucccgcagucggcguccagcggcucugcuuguucgugugugugucguugcaggccuuauuc

SEQ ID NO: 465 - DNA, 31 bp, Artificial Sequence
  5-UTR of human androgen-induced gene 1 protein lacking the 5 terminal oligopyrimidine tract
gccgcccagccggtccaggcctctggcgaac

SEQ ID NO: 466 - RNA, 31 nt, Artificial Sequence
  5-UTR of human androgen-induced gene 1 protein lacking the 5 terminal oligopyrimidine tract mRNA
gccgcccagccgguccaggccucuggcgaac

SEQ ID NO: 467 - DNA, 42 bp, Artificial Sequence
  5-UTR of human acid ceramidase lacking the 5 terminal oligopyrimidine tract
gcctctgctggagtccggggagtggcgttggctgctagagcg

SEQ ID NO: 468 - RNA, 42 nt, Artificial Sequence
  5-UTR of human acid ceramidase lacking the 5 terminal oligopyrimidine tract mRNA
gccucugcuggaguccggggaguggcguuggcugcuagagcg

SEQ ID NO: 469 - DNA, 56 bp, Artificial Sequence
  5-UTR of human cytochrome c oxidase subunit 6C lacking the 5 terminal oligopyrimidine tract
agtcaggaaggacgttggtgttgaggttagcatacgtatcaaggacagtaactacc

SEQ ID NO: 470 - RNA, 56 nt, Artificial Sequence
  5-UTR of human cytochrome c oxidase subunit 6C lacking the 5 terminal oligopyrimidine tract mRNA
agucaggaaggacguugguguugagguuagcauacguaucaaggacaguaacuacc

SEQ ID NO: 471 - DNA, 56 bp, Artificial Sequence
  5-UTR of human 60S ribosomal protein L35a lacking the 5 terminal oligopyrimidine tract
accgccatcttggctcctgtggaggcctgctgggaacgggacttctaaaaggaact

SEQ ID NO: 472 - RNA, 56 nt, Artificial Sequence
  5-UTR of human 60S ribosomal protein L35a lacking the 5 terminal oligopyrimidine tract mRNA
accgccaucuuggcuccuguggaggccugcugggaacgggacuucuaaaaggaacu

SEQ ID NO: 473 - DNA, 22 bp, Artificial Sequence
  5-UTR of human ATP binding cassette subfamily B member 7 lacking the 5 terminal oligopyrimidine tract
ggttcctctttcctcgctcaag

SEQ ID NO: 474 - RNA, 22 nt, Artificial Sequence
  5-UTR of human ATP binding cassette subfamily B member 7 lacking the 5 terminal oligopyrimidine tract mRNA
gguuccucuuuccucgcucaag

SEQ ID NO: 475 - DNA, 186 bp, Artificial Sequence
  3-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 476 - RNA, 186 nt, Artificial Sequence
  3-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 477 - DNA, 110 bp, Artificial Sequence
  3-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 478 - RNA, 110 nt, Artificial Sequence
  3-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 479 - DNA, 108 bp, Artificial Sequence
  3-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 480 - RNA, 108 nt, Artificial Sequence
  3-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 481 - DNA, 132 bp, Artificial Sequence
  3-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 482 - RNA, 132 nt, Artificial Sequence
  3-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 483 - DNA, 44 bp, Artificial Sequence
  Center, alpha-complex-binding portion of the 3UTR of an alpha-globin gene (muag)
gcccgatgggcctcccaacgggccctcctcccctccttgcaccg

SEQ ID NO: 484 - RNA, 44 nt, Artificial Sequence
  Center, alpha-complex-binding portion of the 3UTR of an alpha-globin gene (muag) mRNA
gcccgaugggccucccaacgggcccuccuccccuccuugcaccg

SEQ ID NO: 485 - DNA, 186 bp, Artificial Sequence
  albumin7 3UTR
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 486 - RNA, 186 nt, Artificial Sequence
  albumin7 3UTR mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 487 - DNA, 24 bp, Artificial Sequence
  histone stem-loop sequence
caaaggctcttttcagagccacca

SEQ ID NO: 488 - RNA, 24 nt, Artificial Sequence
  histone stem-loop sequence mRNA
caaaggcucuuuucagagccacca

SEQ ID NO: 489 - RNA, 1918 nt, Artificial Sequence
  R1548, R2429, Flu A HA
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 490 - RNA, 1870 nt, Artificial Sequence
  R1265, R2569, Luciferase
gggagaaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 491 - protein, 713 aa, Artificial Sequence
  ZIKV (strain ZikaSPH2015) Polyprotein(93-804)
MRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 492 - protein, 452 aa, Artificial Sequence
  ZIKV (strain ZikaSPH2015) Polyprotein(273-723)
MSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 493 - protein, 713 aa, Artificial Sequence
  ZIKV (isolate Z1106033) Polyprotein(93-804)
MRIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSK

SEQ ID NO: 494 - protein, 452 aa, Artificial Sequence
  ZIKV (isolate Z1106033) Polyprotein(273-723)
MSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 495 - protein, 709 aa, Artificial Sequence
  ZIKV (strain MR 766) Polyprotein(93-800)
MRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 496 - protein, 448 aa, Artificial Sequence
  ZIKV (strain MR 766) Polyprotein(273-719)
MSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 497 - RNA, 54 nt, Artificial Sequence
  ZIKV (strain ZikaSPH2015) SS
ggcgcagauaccagugucggaauuguuggccuccugcugaccacagcuauggca

SEQ ID NO: 498 - RNA, 54 nt, Artificial Sequence
  ZIKV (isolate Z1106033) SS
ggcgcagauacgagugucggaauuguuggccuccugcugaccacagcuauggca

SEQ ID NO: 499 - protein, 30 aa, Artificial Sequence
  ZIKV (strain ZikaSPH2015) SS
RIINARKEKKRRGADTSVGIVGLLLTTAMA

SEQ ID NO: 500 - protein, 30 aa, Artificial Sequence; identical to SEQ ID NO: 499
  ZIKV (isolate Z1106033) SS

SEQ ID NO: 501 - protein, 30 aa, Artificial Sequence
  ZIKV (strain MR 766) SS
RIINARKERKRRGADTSIGIIGLLLTTAMA

SEQ ID NO: 502 - RNA, 90 nt, Artificial Sequence
  ZIKV (strain ZikaSPH2015) SS
agaauaaucaaugcuaggaaggagaagaagagacggggcgcagauacuagugucggaauuguuggccuccugcugaccacagcuauggca

SEQ ID NO: 503 - RNA, 90 nt, Artificial Sequence
  ZIKV (isolate Z1106033) SS
agaauaaucaaugcuaggaaggagaagaagagacgaggcgcagauacuagugucggaauuguuggccuccugcugaccacagcuauggca

SEQ ID NO: 504 - RNA, 90 nt, Artificial Sequence
  ZIKV (strain MR 766) SS
agaauaaucaaugcuaggaaagagaggaagagacguggcgcagacaccagcaucggaaucauuggccuccugcugacuacagccauggca

SEQ ID NO: 505 - RNA, 90 nt, Artificial Sequence
  ZIKV (strain ZikaSPH2015) SS
cggaucaucaacgcccgcaaggagaagaagcggcgcggcgccgacaccagcguggggaucgugggccuccugcugacgaccgccauggcg

SEQ ID NO: 506 - RNA, 90 nt, Artificial Sequence; identical to SEQ ID NO: 505
  ZIKV (isolate Z1106033) SS

SEQ ID NO: 507 - RNA, 90 nt, Artificial Sequence
  ZIKV (strain MR 766) SS
cggaucaucaacgcccgcaaggagcggaagcgccggggcgccgacaccagcaucgggaucaucggccugcugcucacgaccgccauggcg

SEQ ID NO: 508 - RNA, 90 nt, Artificial Sequence
  ZIKV (strain ZikaSPH2015) SS
cggaucaucaacgcccggaaagagaagaagcgcagaggcgccgauaccagcgugggcauugugggccugcugcugacaacagccauggcc

SEQ ID NO: 509 - RNA, 90 nt, Artificial Sequence; identical to SEQ ID NO: 508
  ZIKV (isolate Z1106033) SS

SEQ ID NO: 510 - RNA, 90 nt, Artificial Sequence
  ZIKV (strain MR 766) SS
cggaucaucaacgcccggaaagagcggaagcggagaggcgccgauaccagcaucggcaucaucggccugcugcugaccacagccauggcc

SEQ ID NO: 511 - RNA, 90 nt, Artificial Sequence
  ZIKV (strain ZikaSPH2015) SS
cggaucaucaacgcccggaaagagaagaagcgcagaggcgccgacaccagcgugggcaucgugggccugcugcugacaaccgccauggcc

SEQ ID NO: 512 - RNA, 90 nt, Artificial Sequence; identical to SEQ ID NO: 511
  ZIKV (isolate Z1106033) SS

SEQ ID NO: 513 - RNA, 90 nt, Artificial Sequence
  ZIKV (strain MR 766) SS
cggaucaucaacgcccggaaagagcggaagcggagaggcgccgacaccagcaucggcaucaucggccugcugcugaccaccgccauggcc

SEQ ID NO: 514 - RNA, 90 nt, Artificial Sequence
  ZIKV (strain ZikaSPH2015) SS
cgcaucaucaacgcccgcaaggagaagaagcgccgcggcgccgacaccagcgugggcaucgugggccugcugcugaccaccgccauggcc

SEQ ID NO: 515 - RNA, 90 nt, Artificial Sequence; identical to SEQ ID NO: 514
  ZIKV (isolate Z1106033) SS

SEQ ID NO: 516 - RNA, 90 nt, Artificial Sequence
  ZIKV (strain MR 766) SS
cgcaucaucaacgcccgcaaggagcgcaagcgccgcggcgccgacaccagcaucggcaucaucggccugcugcugaccaccgccauggcc

SEQ ID NO: 517 - RNA, 90 nt, Artificial Sequence; identical to SEQ ID NO: 502
  ZIKV (strain ZikaSPH2015) SS

SEQ ID NO: 518 - RNA, 90 nt, Artificial Sequence; identical to SEQ ID NO: 503
  ZIKV (isolate Z1106033) SS

SEQ ID NO: 519 - protein, 92 aa, Artificial Sequence
  ZIKV (strain ZikaSPH2015) C
MKNPKKKSGGFRIVNMLKRGVARVSPFGGLKRLPAGLLLGHGPIRMVLAILAFLRFTAIKPSLGLINRWGSVGKKEAMEIIKKFKKDLAAML

SEQ ID NO: 520 - protein, 342 aa, Artificial Sequence
  ZIKV (strain ZikaSPH2015) NS1
KETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 521 - protein, 92 aa, Artificial Sequence; identical to SEQ ID NO: 519
  ZIKV (isolate Z1106033) C

SEQ ID NO: 522 - protein, 342 aa, Artificial Sequence
  ZIKV (isolate Z1106033) NS1
KETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 523 - protein, 92 aa, Artificial Sequence
  ZIKV (strain MR 766) C
MKNPKEEIRRIRIVNMLKRGVARVNPLGGLKRLPAGLLLGHGPIRMVLAILAFLRFTAIKPSLGLINRWGSVGKKEAMEIIKKFKKDLAAML

SEQ ID NO: 524 - protein, 342 aa, Artificial Sequence
  ZIKV (strain MR 766) NS1
KETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTA

SEQ ID NO: 525 - RNA, 276 nt, Artificial Sequence
  ZIKV (strain ZikaSPH2015) C CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcaauucuagccuuuuugagauucacggcaaucaagccaucacugggucucaucaauagaugggguucaguggggaaaaaagaggcuauggaaauaauaaagaaguucaagaaagaucuggcugccaugcug

SEQ ID NO: 526 - RNA, 1026 nt, Artificial Sequence
  ZIKV (strain ZikaSPH2015) NS1 CDS mRNA wild type
aaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucgcacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacaagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 527 - RNA, 276 nt, Artificial Sequence
  ZIKV (isolate Z1106033) C CDS mRNA wild type
augaaaaacccaaaaaagaaauccggaggauuccggauugucaauaugcuaaaacgcggaguagcccgugugagccccuuugggggcuugaagaggcugccagccggacuucugcugggucaugggcccaucaggauggucuuggcgauucuagccuuuuugagauucacggcaaucaagccaucacugggucucaucaauagaugggguucaguggggaaaaaagaggcuauggaaauaauaaagaaguucaagaaagaucuggcugccaugcug

SEQ ID NO: 528 - RNA, 1026 nt, Artificial Sequence
  ZIKV (isolate Z1106033) NS1 CDS mRNA wild type
aaggagacgagaugcgguacagggguguucgucuauaacgacguugaagccuggagggacagguacaaguaccauccugacuccccccguagauuggcagcagcagucaagcaagccugggaagaugguaucugcgggaucuccucuguuucaagaauggaaaacaucauguggagaucaguagaaggggagcucaacgcaauccuggaagagaauggaguucaacugacggucguugugggaucuguaaaaaaccccauguggagagguccacagagauugcccgugccugugaacgagcugccccacggcuggaaggcuugggggaaaucguacuucgucagagcagcaaagacaaauaacagcuuugucguggauggugacacacugaaggaaugcccacucaaacauagagcauggaacagcuuucuuguggaggaucauggguucgggguauuucacacuagugucuggcucaagguuagagaagauuauucauuagagugugauccagccguuauuggaacagcuguuaagggaaaggaggcuguacacagugaucuaggcuacuggauugagagugagaagaaugacacauggaggcugaagagggcccaucugaucgagaugaaaacaugugaauggccaaagucccacacauuguggacagauggaauagaagagagugaucugaucauacccaagucuuuagcugggccacucagccaucacaauaccagagagggcuacaggacccaaaugaaagggccauggcacagugaagagcuugaaauucgguuugaggaaugcccaggcacuaagguccacguggaggaaacauguggaacgagaggaccaucucugagaucaaccacugcaagcggaagggugaucgaggaauggugcugcagggagugcacaaugcccccacugucguuccgggcuaaagauggcuguugguauggaauggagauaaggcccaggaaagaaccagaaagcaacuuaguaaggucaauggugacugca

SEQ ID NO: 529 - RNA, 276 nt, Artificial Sequence
  ZIKV (strain MR 766) C CDS mRNA wild type
augaaaaaccccaaagaagaaauccggaggauccggauugucaauaugcuaaaacgcggaguagcccguguaaaccccuugggagguuugaagagguugccagccggacuucugcugggucauggacccaucagaaugguuuuggcgauacuagccuuuuugagauuuacagcaaucaagccaucacugggccuuaucaacagaugggguuccguggggaaaaaagaggcuauggaaauaauaaagaaguucaagaaagaucuugcugccauguug

SEQ ID NO: 530 - RNA, 1026 nt, Artificial Sequence
  ZIKV (strain MR 766) NS1 CDS mRNA wild type
aaggaaacgagauguggcacggggguauucaucuauaaugauguugaagccuggagggaccgguacaaguaccauccugacuccccccgcagauuggcagcagcagucaagcaggccugggaagaggggaucugugggaucucauccguuucaagaauggaaaacaucauguggaaaucaguagaaggggagcucaaugcuauccuagaggagaauggaguucaacugacaguuguugugggaucuguaaaaaaccccauguggagagguccacaaagauugccagugccugugaaugagcugccccauggcuggaaagccugggggaaaucguauuuuguuagggcggcaaagaccaacaacaguuuuguugucgacggugacacacugaaggaauguccgcuugagcacagagcauggaauaguuuucuuguggaggaucacggguuuggagucuuccacaccagugucuggcuuaaggucagagaagauuacucauuagaaugugacccagccgucauaggaacagcuguuaagggaagggaggccgcgcacagugaucugggcuauuggauugaaagugaaaagaaugacacauggaggcugaagagggcccaccugauugagaugaaaacaugugaauggccaaagucucacacauuguggacagauggaguagaagaaagugaucuuaucauacccaagucuuuagcugguccacucagccaccacaacaccagagaggguuacagaacccaagugaaagggccauggcacagugaagagcuugaaauccgguuugaggaauguccaggcaccaagguuuacguggaggagacaugcggaacuagaggaccaucucugagaucaacuacugcaaguggaagggucauugaggaauggugcuguagggaaugcacaaugcccccacuaucguuucgagcaaaagacggcugcugguauggaauggagauaaggcccaggaaagaaccagagagcaacuuagugaggucaauggugacagcg

SEQ ID NO: 531 - DNA, 13 bp, Artificial Sequence
  Kozak
gccgccaccatgg

SEQ ID NO: 532 - RNA, 13 nt, Artificial Sequence
  Kozak mRNA
gccgccaccaugg

SEQ ID NO: 533 - protein, 712 aa, Artificial Sequence; identical to SEQ ID NO: 16
  ZIKV (strain ZikaSPH2015) Polyprotein(93-804)

SEQ ID NO: 534 - protein, 712 aa, Artificial Sequence; identical to SEQ ID NO: 33
  ZIKV (isolate Z1106033) Polyprotein(93-804)

SEQ ID NO: 535 - protein, 708 aa, Artificial Sequence; identical to SEQ ID NO: 50
  ZIKV (strain MR 766) Polyprotein(93-800)

SEQ ID NO: 536 - protein, 712 aa, Artificial Sequence
  ZIKV (strain NatalRGN) Polyprotein(93-804)
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 537 - protein, 687 aa, Artificial Sequence
  ZIKV (strain ZikaSPH2015) Polyprotein(108-794)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 538 - protein, 687 aa, Artificial Sequence
  ZIKV (isolate Z1106033) Polyprotein(108-794)
TSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 539 - protein, 683 aa, Artificial Sequence
  ZIKV (strain MR 766) Polyprotein(108-790)
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 540 - protein, 687 aa, Artificial Sequence
  ZIKV (strain NatalRGN) Polyprotein(108-794)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 541 - protein, 451 aa, Artificial Sequence; identical to SEQ ID NO: 17
  ZIKV (strain ZikaSPH2015) Polyprotein(273-723)

SEQ ID NO: 542 - protein, 451 aa, Artificial Sequence; identical to SEQ ID NO: 34
  ZIKV (isolate Z1106033) Polyprotein(273-723)

SEQ ID NO: 543 - protein, 447 aa, Artificial Sequence; identical to SEQ ID NO: 51
  ZIKV (strain MR 766) Polyprotein(273-719)

SEQ ID NO: 544 - protein, 451 aa, Artificial Sequence; identical to SEQ ID NO: 34
  ZIKV (strain NatalRGN) Polyprotein(273-723)

SEQ ID NO: 545 - protein, 687 aa, Artificial Sequence
  ZIKV (strain ZikaSPH2015) Polyprotein(108-794)(F398S)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 546 - protein, 687 aa, Artificial Sequence
  ZIKV (isolate Z1106033) Polyprotein(108-794)(F398S)
TSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 547 - protein, 683 aa, Artificial Sequence
  ZIKV (strain MR 766) Polyprotein(108-790)(F398S)
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLSGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 548 - protein, 687 aa, Artificial Sequence
  ZIKV (strain NatalRGN) Polyprotein(108-794)(F398S)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 549 - protein, 687 aa, Artificial Sequence
  ZIKV (strain ZikaSPH2015) Polyprotein(108-794)(N444Q)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVQDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 550 - protein, 687 aa, Artificial Sequence
  ZIKV (isolate Z1106033) Polyprotein(108-794)(N444Q)
TSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVQDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 551 - protein, 687 aa, Artificial Sequence
  ZIKV (strain NatalRGN) Polyprotein(108-794)(N444Q)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVQDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 552 - protein, 687 aa, Artificial Sequence
  ZIKV (strain ZikaSPH2015) Polyprotein(108-694)-Cterm-JAEV1-E(400-500)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 553 - protein, 687 aa, Artificial Sequence
  ZIKV (isolate Z1106033) Polyprotein(108-694)-Cterm-JAEV1-E(400-500)
TSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 554 - protein, 683 aa, Artificial Sequence
  ZIKV (strain MR 766) Polyprotein(108-690)-Cterm-JAEV1-E(400-500)
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 555 - protein, 687 aa, Artificial Sequence
  ZIKV (strain NatalRGN) Polyprotein(108-694)-Cterm-JAEV1-E(400-500)
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 556 - protein, 712 aa, Artificial Sequence; identical to SEQ ID NO: 16
  ZIKV (strain ZikaSPH2015) Polyprotein(93-804)

SEQ ID NO: 557 - protein, 711 aa, Artificial Sequence
  ZIKV prME variant
IINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 558 - protein, 710 aa, Artificial Sequence
  ZIKV prME variant
INARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 559 - protein, 709 aa, Artificial Sequence
  ZIKV prME variant
NARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 560 - protein, 708 aa, Artificial Sequence
  ZIKV prME variant
ARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 561 - protein, 707 aa, Artificial Sequence
  ZIKV prME variant
RKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 562 - protein, 706 aa, Artificial Sequence
  ZIKV prME variant
KEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 563 - protein, 705 aa, Artificial Sequence
  ZIKV prME variant
EKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 564 - protein, 704 aa, Artificial Sequence
  ZIKV prME variant
KKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 565 - protein, 703 aa, Artificial Sequence
  ZIKV prME variant
KRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 566 - protein, 702 aa, Artificial Sequence
  ZIKV prME variant
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 567 - protein, 701 aa, Artificial Sequence
  ZIKV prME variant
RGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 568 - protein, 700 aa, Artificial Sequence
  ZIKV prME variant
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 569 - protein, 699 aa, Artificial Sequence
  ZIKV prME variant
ADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 570 - protein, 698 aa, Artificial Sequence
  ZIKV prME variant
DTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 571 - protein, 697 aa, Artificial Sequence
  ZIKV prME variant
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 572 - protein, 697 aa, Artificial Sequence
  ZIKV prME variant
TSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 573 - protein, 701 aa, Artificial Sequence
  ZIKV prME variant
RGADTSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 574 - protein, 709 aa, Artificial Sequence
  ZIKV prME variant
RGLSSRKRRSHDVLTVQFLILGMLLMTGGVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 575 - protein, 709 aa, Artificial Sequence
  ZIKV prME variant
RGLSSRKRRSHDVLTVQFLILGMLLMTGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 576 - protein, 706 aa, Artificial Sequence
  ZIKV prME variant
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 577 - protein, 705 aa, Artificial Sequence
  ZIKV prME variant
IINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 578 - protein, 704 aa, Artificial Sequence
  ZIKV prME variant
INARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 579 - protein, 703 aa, Artificial Sequence
  ZIKV prME variant
NARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 580 - protein, 702 aa, Artificial Sequence
  ZIKV prME variant
ARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 581 - protein, 701 aa, Artificial Sequence
  ZIKV prME variant
RKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 582 - protein, 700 aa, Artificial Sequence
  ZIKV prME variant
KEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 583 - protein, 699 aa, Artificial Sequence
  ZIKV prME variant
EKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 584 - protein, 698 aa, Artificial Sequence
  ZIKV prME variant
KKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 585 - protein, 697 aa, Artificial Sequence
  ZIKV prME variant
KRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 586 - protein, 696 aa, Artificial Sequence
  ZIKV prME variant
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 587 - protein, 695 aa, Artificial Sequence
  ZIKV prME variant
RGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 588 - protein, 694 aa, Artificial Sequence
  ZIKV prME variant
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 589 - protein, 693 aa, Artificial Sequence
  ZIKV prME variant
ADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 590 - protein, 692 aa, Artificial Sequence
  ZIKV prME variant
DTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 591 - protein, 691 aa, Artificial Sequence
  ZIKV prME variant
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 592 - protein, 691 aa, Artificial Sequence
  ZIKV prME variant
TSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 593 - protein, 695 aa, Artificial Sequence
  ZIKV prME variant
RGADTSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 594 - protein, 703 aa, Artificial Sequence
  ZIKV prME variant
RGLSSRKRRSHDVLTVQFLILGMLLMTGGVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 595 - protein, 703 aa, Artificial Sequence
  ZIKV prME variant
RGLSSRKRRSHDVLTVQFLILGMLLMTGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGC

SEQ ID NO: 596 - protein, 703 aa, Artificial Sequence
  ZIKV prME variant
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 597 - protein, 702 aa, Artificial Sequence
  ZIKV prME variant
IINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 598 - protein, 701 aa, Artificial Sequence
  ZIKV prME variant
INARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 599 - protein, 700 aa, Artificial Sequence
  ZIKV prME variant
NARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 600 - protein, 699 aa, Artificial Sequence
  ZIKV prME variant
ARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 601 - protein, 698 aa, Artificial Sequence
  ZIKV prME variant
RKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 602 - protein, 697 aa, Artificial Sequence
  ZIKV prME variant
KEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 603 - protein, 696 aa, Artificial Sequence
  ZIKV prME variant
EKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 604 - protein, 695 aa, Artificial Sequence
  ZIKV prME variant
KKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 605 - protein, 694 aa, Artificial Sequence
  ZIKV prME variant
KRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 606 - protein, 693 aa, Artificial Sequence
  ZIKV prME variant
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 607 - protein, 692 aa, Artificial Sequence
  ZIKV prME variant
RGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 608 - protein, 691 aa, Artificial Sequence
  ZIKV prME variant
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 609 - protein, 690 aa, Artificial Sequence
  ZIKV prME variant
ADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 610 - protein, 689 aa, Artificial Sequence
  ZIKV prME variant
DTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 611 - protein, 688 aa, Artificial Sequence
  ZIKV prME variant
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 612 - protein, 688 aa, Artificial Sequence
  ZIKV prME variant
TSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 613 - protein, 692 aa, Artificial Sequence
  ZIKV prME variant
RGADTSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 614 - protein, 700 aa, Artificial Sequence
  ZIKV prME variant
RGLSSRKRRSHDVLTVQFLILGMLLMTGGVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 615 - protein, 700 aa, Artificial Sequence
  ZIKV prME variant
RGLSSRKRRSHDVLTVQFLILGMLLMTGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAD

SEQ ID NO: 616 - protein, 702 aa, Artificial Sequence
  ZIKV prME variant
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 617 - protein, 700 aa, Artificial Sequence
  ZIKV prME variant
INARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 618 - protein, 701 aa, Artificial Sequence
  ZIKV prME variant
IINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 619 - protein, 699 aa, Artificial Sequence
  ZIKV prME variant
NARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 620 - protein, 698 aa, Artificial Sequence
  ZIKV prME variant
ARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 621 - protein, 697 aa, Artificial Sequence
  ZIKV prME variant
RKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 622 - protein, 696 aa, Artificial Sequence
  ZIKV prME variant
KEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 623 - protein, 695 aa, Artificial Sequence
  ZIKV prME variant
EKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 624 - protein, 694 aa, Artificial Sequence
  ZIKV prME variant
KKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 625 - protein, 693 aa, Artificial Sequence
  ZIKV prME variant
KRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 626 - protein, 692 aa, Artificial Sequence
  ZIKV prME variant
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 627 - protein, 691 aa, Artificial Sequence
  ZIKV prME variant
RGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 628 - protein, 690 aa, Artificial Sequence; identical to SEQ ID NO: 421
  ZIKV prME variant

SEQ ID NO: 629 - protein, 689 aa, Artificial Sequence
  ZIKV prME variant
ADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 630 - protein, 688 aa, Artificial Sequence
  ZIKV prME variant
DTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 631 - protein, 687 aa, Artificial Sequence; identical to SEQ ID NO: 537
  ZIKV (strain ZikaSPH2015) Polyprotein(108-794)

SEQ ID NO: 632 - protein, 687 aa, Artificial Sequence
  ZIKV prME variant
TSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 633 - protein, 691 aa, Artificial Sequence
  ZIKV prME variant
RGADTSVGIVGLLLTTAMAAAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 634 - protein, 699 aa, Artificial Sequence
  ZIKV prME variant
RGLSSRKRRSHDVLTVQFLILGMLLMTGGVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 635 - protein, 699 aa, Artificial Sequence
  ZIKV prME variant
RGLSSRKRRSHDVLTVQFLILGMLLMTGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 636 - protein, 712 aa, Artificial Sequence; identical to SEQ ID NO: 16
  KU321639.1 prME-long

SEQ ID NO: 637 - protein, 712 aa, Artificial Sequence; identical to SEQ ID NO: 33
  KU312312.1 prME-long

SEQ ID NO: 638 - protein, 708 aa, Artificial Sequence; identical to SEQ ID NO: 50
  AY632535.2 prME-long

SEQ ID NO: 639 - protein, 712 aa, Artificial Sequence; identical to SEQ ID NO: 536
  KU527068.1 prME-long

SEQ ID NO: 640 - protein, 712 aa, Artificial Sequence
  KU720415.1 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 641 - protein, 706 aa, Artificial Sequence
  DQ859059.1 prME-long
RIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 642 - protein, 712 aa, Artificial Sequence
  KX377335.1 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHRKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 643 - protein, 712 aa, Artificial Sequence
  LC002520.1 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 644 - protein, 708 aa, Artificial Sequence
  KU963573.2 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 645 - protein, 712 aa, Artificial Sequence
  KX694534.2 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGRGIHQIFGAAFKSLFGGMSWFSQILIGTLLMWLGLNTKNGSISLMCLALGGVLIFLSTAVSADVGCSVDFSK

SEQ ID NO: 646 - protein, 712 aa, Artificial Sequence
  KX447520.1 prME-long
RIINARKEKKRRGADASVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 647 - protein, 712 aa, Artificial Sequence
  KX369547.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGLALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 648 - protein, 712 aa, Artificial Sequence
  KX447515.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWYRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 649 - protein, 712 aa, Artificial Sequence
  KU501217.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 650 - protein, 712 aa, Artificial Sequence
  KU312314.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVLAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 651 - protein, 712 aa, Artificial Sequence
  KX446950.2 prME-long
RIINARKEKKRRGADTSVGIVGLLLTTAMAAEVTRRGSAYYMYLDRNDAGEAISFPTTLGMNKCYIQIMDLGHMCDATMSYECPTLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 652 - protein, 712 aa, Artificial Sequence
  KY003157.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTVVSADVGCSVDFSK

SEQ ID NO: 653 - protein, 712 aa, Artificial Sequence
  KX811222.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSAWVVYGTCHHKKGEARRSRRAVTLPSHSTRKLQTRPQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 654 - protein, 712 aa, Artificial Sequence
  KX447516.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSKKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 655 - protein, 712 aa, Artificial Sequence
  KX520666.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTRQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 656 - protein, 712 aa, Artificial Sequence
  KU729218.1 prME-long
RIINARKEKKRRSADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDTQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 657 - protein, 712 aa, Artificial Sequence
  KU761561.1 prME-long
RIINARKEKKRRGADTNVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGARRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 658 - protein, 712 aa, Artificial Sequence
  KY317938.1 prME-long
RIINARKEKKRRGAETSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 659 - protein, 712 aa, Artificial Sequence
  KY075939.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSLRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 660 - protein, 712 aa, Artificial Sequence
  KX806557.2 prME-long
RIINARKEKKRRGADTNVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWMFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 661 - protein, 712 aa, Artificial Sequence
  KU870645.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWILRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGIGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 662 - protein, 712 aa, Artificial Sequence
  KU729217.2 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVSTTVSNMAEVRSYCYEATISDIASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTAVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 663 - protein, 712 aa, Artificial Sequence
  KU497555.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 664 - protein, 712 aa, Artificial Sequence
  KX087101.3 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVELQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 665 - protein, 712 aa, Artificial Sequence
  KY075932.1 prME-long
RIINARKEKKRRGAETSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRIENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 666 - protein, 712 aa, Artificial Sequence
  KY014317.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESIENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 667 - protein, 712 aa, Artificial Sequence
  KU758876.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGVKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISFMCLALGGVLIFLSTAVSADVGCSVDFSK

SEQ ID NO: 668 - protein, 712 aa, Artificial Sequence
  KU758874.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 669 - protein, 712 aa, Artificial Sequence
  KY014314.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKEAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 670 - protein, 712 aa, Artificial Sequence
  KU926310.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGADGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 671 - protein, 712 aa, Artificial Sequence
  KU761560.1 prME-long
RIINAGKEKKRRGADTNVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGARRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 672 - protein, 712 aa, Artificial Sequence
  KY317939.1 prME-long
RIINARKEKKRRGAETSVGIVGLLLTTAMAAEVTRRGSAYYMYLDRKDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 673 - protein, 712 aa, Artificial Sequence
  KY075937.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMVSDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 674 - protein, 712 aa, Artificial Sequence
  LC191864.1 prME-long
RIINARKEKKRRGADTNVGIVGLLLTTAMAAEVTRRGSAYYMYLDRNDAGEAISFPTTLGMNKCYIQIMDLGHMCDATMSYECPMLDEGVEPDDVDCWCNMTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 675 - protein, 712 aa, Artificial Sequence
  KX447517.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEAALGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQTLIGTLLMWLGLNTKNGSISLMCLALGGVLIFLSTAVSADVGCSVDFSK

SEQ ID NO: 676 - protein, 712 aa, Artificial Sequence
  KU922923.1 prME-long
RIINARKEKKRRGAETSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIALAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 677 - protein, 712 aa, Artificial Sequence
  KY003156.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGISNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGILGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 678 - protein, 712 aa, Artificial Sequence
  KU312313.1 prME-long
RIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSIRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSK

SEQ ID NO: 679 - protein, 712 aa, Artificial Sequence
  KY075935.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEAQRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 680 - protein, 712 aa, Artificial Sequence
  KY014320.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQARSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 681 - protein, 712 aa, Artificial Sequence
  KX827309.1 prME-long
RIINARKEKKRRGADTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 682 - protein, 712 aa, Artificial Sequence
  KU681081.3 prME-long
RIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSADVGCSVDFSK

SEQ ID NO: 683 - protein, 712 aa, Artificial Sequence
  KU744693.1 prME-long
RIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTAMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMLVNDTGHETDENRAKVEITPNSPRAEATLGGFGSLGLDCEPRTGLDFSDLYYLTMNNKHWLAHKEWFHDIPLPWHAGAATGTPHWNNKEALVEFKDAHAKRQTVVVLGSQEGAVHTALAGALEAEMDGAKGRLSSGHLKCRLKMDKLRLKGVSYSLCTAAFTFTKIPAETVDGTVTVEGQYGGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIIGAAFKSLFGGMSWFSQILIGTLLMWLGLNTKNGSISLMCLALGGVLIFLSTAVSGGVGCSVDFSK

SEQ ID NO: 684 - protein, 712 aa, Artificial Sequence
  KY328290.1 prME-long
RIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFSKIPAETLHGTVTEEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 685 - protein, 712 aa, Artificial Sequence
  KX694532.2 prME-long
RIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSK

SEQ ID NO: 686 - protein, 712 aa, Artificial Sequence
  KU955593.1 prME-long
RIINARKEKKRRGTDTSVGIVGLLLTTAMAVEVTRRGNAYYMYLDRSDAGEAISFPTTMGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLMCLALGGVLIFLSTAVSADVGCSVDFSK

SEQ ID NO: 687 - protein, 712 aa, Artificial Sequence
  KY272987.1 prME-long
RIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLVCLALGGVLIFLSTAVSADVGCSVDFSK

SEQ ID NO: 688 - protein, 712 aa, Artificial Sequence
  EU545988.1 prME-long
RIINARKEKKRRGTDTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSK

SEQ ID NO: 689 - protein, 712 aa, Artificial Sequence
  KU681082.3 prME-long
RIINARKEKKRRGADTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAVIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSK

SEQ ID NO: 690 - protein, 712 aa, Artificial Sequence
  KX601167.1 prME-long
RIINARKEKKRRGADTSVGIVGLLLTTAMAVEVTRRGSAYYMYLDRSDAGEAISFPTTLGVNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWYRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSK

SEQ ID NO: 691 - protein, 712 aa, Artificial Sequence
  KX694533.2 prME-long
RIINARKEKKRRGADTSVGIVGLLLTTAMAVEVTRRGSAYYMYLDRSDAGKAISFPTTLGVNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDIGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSK

SEQ ID NO: 692 - protein, 712 aa, Artificial Sequence
  KY288905.1 prME-long
RIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 693 - protein, 712 aa, Artificial Sequence
  KF268950.1 prME-long
RIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSADVGCSVDFSK

SEQ ID NO: 694 - protein, 712 aa, Artificial Sequence
  KF383121.1 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 695 - protein, 706 aa, Artificial Sequence
  KF268949.1 prME-long
RIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 696 - protein, 712 aa, Artificial Sequence
  KU955595.1 prME-long
RIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 697 - protein, 712 aa, Artificial Sequence
  KF383116.1 prME-long
RIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 698 - protein, 706 aa, Artificial Sequence
  KU963574.2 prME-long
RIINARKERKRRGADASIGIVSLLLTTVMAAEITRRGSAYYMYLDRSDAGKAISFVTTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHSGADTETPHWNNKEALVEFKDAHAKRQTVVVLGSQEGAVHTALAGALEAEMDGAKGRLSSGHLKCRLKMDKLRLKGVSYSLCTAAFTFTKVPAETLHGTVTVEVQYAGRDGPCKVPAQMAVDMQTLTPVGRLITANPVITESTENSKMMLELDPPFGDSYIVIGVGDKKITHHWHRSGSIIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 699 - protein, 706 aa, Artificial Sequence
  KX601166.1 prME-long
RIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 700 - protein, 712 aa, Artificial Sequence
  KF383118.1 prME-long
RIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSK

SEQ ID NO: 701 - protein, 710 aa, Artificial Sequence
  KF383120.1 prME-long
RIINARKERKRRGADTSIGIIGLLLTTAMAAEITRRGSAYYMYLDRSDAGKAISFATTMGVNKCHVQIMDLGHMCDATMSYECPMLDEGVEPDDVDCWCNTTSTWVVYGTCHHKKGEARPSRRAVTLPSHSTRKLQTRSQTWLESREYTKHLIKVENWILRNPGFTVAALAMAWLLGNSTSQRVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRIKMDKLRLKGVSYSLCTAAFTFSKVPAETLHGTVTVEVQYAGRDGPCKVPAQMAVDMQTLTPVGRLITANPIITESTENSRMMLELDPPFGDSYIVIGVGDKKITHHWHRSGSTIGKAFEATVRGAKRMAVLGDTAWDFGSVGGVFNSLGKGVHQVFGAAFKSLFGGMSWFSQILIGTLLVWLGLNTKNGSISLACLALGGAMIFLSTAVSADVGCSVDF

SEQ ID NO: 702 - protein, 687 aa, Artificial Sequence; identical to SEQ ID NO: 537
  KU321639.1 prME-short

SEQ ID NO: 703 - protein, 687 aa, Artificial Sequence; identical to SEQ ID NO: 538
  KU312312.1 prME-short

SEQ ID NO: 704 - protein, 683 aa, Artificial Sequence; identical to SEQ ID NO: 539
  AY632535.2 prME-short

SEQ ID NO: 705 - protein, 687 aa, Artificial Sequence; identical to SEQ ID NO: 540
  KU527068.1 prME-short

SEQ ID NO: 706 - protein, 687 aa, Artificial Sequence
  KX421193.1 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 707 - protein, 687 aa, Artificial Sequence
  KX377335.1 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHRKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 708 - protein, 687 aa, Artificial Sequence
  LC002520.1 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 709 - protein, 681 aa, Artificial Sequence
  DQ859059.1 prME-short
TSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 710 - protein, 683 aa, Artificial Sequence
  KU963573.2 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 711 - protein, 687 aa, Artificial Sequence
  KX694534.2 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGRGIHQIFGAAFKSLFGGMSWFSQILIGTLLMWLGLNTKNGSISLMCLALGGVLIFLSTAVSA

SEQ ID NO: 712 - protein, 687 aa, Artificial Sequence
  KX369547.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGLALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 713 - protein, 687 aa, Artificial Sequence
  KX447515.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWYRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 714 - protein, 687 aa, Artificial Sequence
  KU729218.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDTQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 715 - protein, 687 aa, Artificial Sequence
  KU501217.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 716 - protein, 687 aa, Artificial Sequence
  KU312314.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVLAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 717 - protein, 687 aa, Artificial Sequence
  KX446950.2 prME-short
TSVGIVGLLLTTAMAAEVTRRGSAYYMYLDRNDAGEAISFPTTLGMNKCYIQIMDLGHMCDATMSYECPTLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 718 - protein, 687 aa, Artificial Sequence
  KY003157.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTVVSA

SEQ ID NO: 719 - protein, 687 aa, Artificial Sequence
  KX811222.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSAWVVYGTCHHKKGEARRSRRAVTLPSHSTRKLQTRPQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 720 - protein, 687 aa, Artificial Sequence
  KX447516.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSKKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 721 - protein, 687 aa, Artificial Sequence
  KX520666.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTRQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 722 - protein, 687 aa, Artificial Sequence
  KU497555.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 723 - protein, 687 aa, Artificial Sequence
  KY075939.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSLRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 724 - protein, 687 aa, Artificial Sequence
  KY075932.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRIENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 725 - protein, 687 aa, Artificial Sequence
  KU870645.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWILRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGIGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 726 - protein, 687 aa, Artificial Sequence
  KU729217.2 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVSTTVSNMAEVRSYCYEATISDIASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTAVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 727 - protein, 687 aa, Artificial Sequence
  KX087101.3 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVELQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 728 - protein, 687 aa, Artificial Sequence
  KY014317.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESIENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 729 - protein, 687 aa, Artificial Sequence
  KU758876.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGVKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISFMCLALGGVLIFLSTAVSA

SEQ ID NO: 730 - protein, 687 aa, Artificial Sequence
  KU758874.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 731 - protein, 687 aa, Artificial Sequence
  KY317939.1 prME-short
TSVGIVGLLLTTAMAAEVTRRGSAYYMYLDRKDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 732 - protein, 687 aa, Artificial Sequence
  KY014314.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKEAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 733 - protein, 687 aa, Artificial Sequence
  KX447517.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEAALGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQTLIGTLLMWLGLNTKNGSISLMCLALGGVLIFLSTAVSA

SEQ ID NO: 734 - protein, 687 aa, Artificial Sequence
  KU926310.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGADGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 735 - protein, 687 aa, Artificial Sequence
  KU922923.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIALAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 736 - protein, 687 aa, Artificial Sequence
  KY075937.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMVSDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 737 - protein, 687 aa, Artificial Sequence
  KY003156.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGISNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGILGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 738 - protein, 687 aa, Artificial Sequence
  KU312313.1 prME-short
TSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSIRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 739 - protein, 687 aa, Artificial Sequence
  KY075935.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEAQRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 740 - protein, 687 aa, Artificial Sequence
  KY014320.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQARSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 741 - protein, 687 aa, Artificial Sequence
  KY328290.1 prME-short
TSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFSKIPAETLHGTVTEEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 742 - protein, 687 aa, Artificial Sequence
  KU681081.3 prME-short
TSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSA

SEQ ID NO: 743 - protein, 687 aa, Artificial Sequence
  KX827309.1 prME-short
TSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 744 - protein, 687 aa, Artificial Sequence
  KU955593.1 prME-short
TSVGIVGLLLTTAMAVEVTRRGNAYYMYLDRSDAGEAISFPTTMGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLMCLALGGVLIFLSTAVSA

SEQ ID NO: 745 - protein, 687 aa, Artificial Sequence
  KY272987.1 prME-short
TSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLVCLALGGVLIFLSTAVSA

SEQ ID NO: 746 - protein, 687 aa, Artificial Sequence
  KY007221.1 prME-short
TSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVNNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLVCLALGGVLIFLSTAVSA

SEQ ID NO: 747 - protein, 687 aa, Artificial Sequence
  EU545988.1 prME-short
TSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 748 - protein, 687 aa, Artificial Sequence
  KU681082.3 prME-short
TSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAVIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 749 - protein, 687 aa, Artificial Sequence
  KX601167.1 prME-short
TSVGIVGLLLTTAMAVEVTRRGSAYYMYLDRSDAGEAISFPTTLGVNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWYRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 750 - protein, 687 aa, Artificial Sequence
  KX694533.2 prME-short
TSVGIVGLLLTTAMAVEVTRRGSAYYMYLDRSDAGKAISFPTTLGVNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDIGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 751 - protein, 687 aa, Artificial Sequence
  KY288905.1 prME-short
TSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 752 - protein, 687 aa, Artificial Sequence
  KF268950.1 prME-short
TSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 753 - protein, 687 aa, Artificial Sequence
  KF383121.1 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 754 - protein, 681 aa, Artificial Sequence
  KF268949.1 prME-short
TSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 755 - protein, 687 aa, Artificial Sequence
  KU955595.1 prME-short
TSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 756 - protein, 687 aa, Artificial Sequence
  KF383116.1 prME-short
TSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 757 - protein, 681 aa, Artificial Sequence
  KX601166.1 prME-short
TSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 758 - protein, 687 aa, Artificial Sequence
  KF383118.1 prME-short
TSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 759 - protein, 686 aa, Artificial Sequence
  KX447520.1 prME-short
SVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 760 - protein, 687 aa, Artificial Sequence
  KU761561.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGARRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 761 - protein, 687 aa, Artificial Sequence
  KX806557.2 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWMFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 762 - protein, 687 aa, Artificial Sequence
  LC191864.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNMTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 763 - protein, 687 aa, Artificial Sequence
  KU744693.1 prME-short
TSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTAMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMLVNDTGHETDENRAKVEITPNSPRAEATLGGFGSLGLDCEPRTGLDFSDLYYLTMNNKHWLAHKEWFHDIPLPWHAGAATGTPHWNNKEALVEFKDAHAKRQTVVVLGSQEGAVHTALAGALEAEMDGAKGRLSSGHLKCRLKMDKLRLKGVSYSLCTAAFTFTKIPAETVDGTVTVEGQYGGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIIGAAFKSLFGGMSWFSQILIGTLLMWLGLNTKNGSISLMCLALGGVLIFLSTAVSG

SEQ ID NO: 764 - protein, 684 aa, Artificial Sequence
  KU963574.2 prME-short
GADASIGIVSLLLTTVMAAEITRRGSAYYMYLDRSDAGKAISFVTTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHSGADTETPHWNNKEALVEFKDAHAKRQTVVVLGSQEGAVHTALAGALEAEMDGAKGRLSSGHLKCRLKMDKLRLKGVSYSLCTAAFTFTKVPAETLHGTVTVEVQYAGRDGPCKVPAQMAVDMQTLTPVGRLITANPVITESTENSKMMLELDPPFGDSYIVIGVGDKKITHHWHRSGSIIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 765 - protein, 690 aa, Artificial Sequence
  KF383120.1 prME-short
GADTSIGIIGLLLTTAMAAEITRRGSAYYMYLDRSDAGKAISFATTMGVNKCHVQIMDLGHMCDATMSYECPMLDEGVEPDDVDCWCNTTSTWVVYGTCHHKKGEARPSRRAVTLPSHSTRKLQTRSQTWLESREYTKHLIKVENWILRNPGFTVAALAMAWLLGNSTSQRVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRIKMDKLRLKGVSYSLCTAAFTFSKVPAETLHGTVTVEVQYAGRDGPCKVPAQMAVDMQTLTPVGRLITANPIITESTENSRMMLELDPPFGDSYIVIGVGDKKITHHWHRSGSTIGKAFEATVRGAKRMAVLGDTAWDFGSVGGVFNSLGKGVHQVFGAAFKSLFGGMSWFSQILIGTLLVWLGLNTKNGSISLACLALGGAMIFLSTAVSA

SEQ ID NO: 766 - protein, 451 aa, Artificial Sequence; identical to SEQ ID NO: 17
  KU321639.1 solE

SEQ ID NO: 767 - protein, 451 aa, Artificial Sequence; identical to SEQ ID NO: 34
  KU312312.1 solE

SEQ ID NO: 768 - protein, 447 aa, Artificial Sequence; identical to SEQ ID NO: 51
  AY632535.2 solE

SEQ ID NO: 769 - protein, 451 aa, Artificial Sequence; identical to SEQ ID NO: 34
  KU527068.1 solE

SEQ ID NO: 770 - protein, 451 aa, Artificial Sequence
  KX421193.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 771 - protein, 451 aa, Artificial Sequence
  LC002520.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 772 - protein, 445 aa, Artificial Sequence
  DQ859059.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 773 - protein, 447 aa, Artificial Sequence
  KU963573.2 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 774 - protein, 451 aa, Artificial Sequence
  KY075939.1 solE
SQKVIYLVMILLIAPAYSLRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 775 - protein, 451 aa, Artificial Sequence
  KX447516.1 solE
SKKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 776 - protein, 451 aa, Artificial Sequence
  KX447515.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWYRSGSTIGKAFEATVRGAKRMAVLGDTAWDFGS

SEQ ID NO: 777 - protein, 451 aa, Artificial Sequence
  KU758874.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 778 - protein, 451 aa, Artificial Sequence
  KU729218.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDTQTLTPVGRLITANPVITESTENSKMMLELDPPFGDSYIVIGVGEKKITHHWHRSGSTIGKAFEATVRGAKRMAVLGDTAWDFGS

SEQ ID NO: 779 - protein, 451 aa, Artificial Sequence
  KU501217.1 solE
SQKVIYLVMILLIAPAYSIRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 780 - protein, 451 aa, Artificial Sequence
  KU761561.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGARRMAVLGDTAWDFGS

SEQ ID NO: 781 - protein, 451 aa, Artificial Sequence
  KY075937.1 solE
SQKVIYLVMILLIAPAYSIRCIGVSNRDFVEGMSGGTWVDVVLEHGGCVTVMAQDKPTVDIELVTTTVSNMAEVRSYCYEASISDMVSDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 782 - protein, 451 aa, Artificial Sequence
  KY014317.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESIENSKMMLELDPPFGDSYIVIGVGEKKITHHWHRSGSTIGKAFEATVRGAKRMAVLGDTAWDFGS

SEQ ID NO: 783 - protein, 451 aa, Artificial Sequence
  KU870645.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGIGEKKITHHWHRSGSTIGKAFEATVRGAKRMAVLGDTAWDFGS

SEQ ID NO: 784 - protein, 451 aa, Artificial Sequence
  KU922923.1 solE
SQKVIYLVMILLIALAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 785 - protein, 451 aa, Artificial Sequence
  KU497555.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 786 - protein, 451 aa, Artificial Sequence
  KU312314.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVLAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 787 - protein, 451 aa, Artificial Sequence
  KY014314.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKEAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 788 - protein, 451 aa, Artificial Sequence
  KX447517.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEAALGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 789 - protein, 451 aa, Artificial Sequence
  KU729217.2 solE
SQKVIYLVMILLIAPAYSIRCIGVSNRDFVEGMSGGTWVDVVLEHGGCVTVMAQDKPTVDIELVSTTVSNMAEVRSYCYEATISDIASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTAVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 790 - protein, 451 aa, Artificial Sequence
  KY328290.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFSKIPAETLHGTVTEEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 791 - protein, 451 aa, Artificial Sequence
  KX087101.3 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVELQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 792 - protein, 451 aa, Artificial Sequence
  KY003156.1 solE
SQKVIYLVMILLIAPAYSIRCIGISNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGILGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 793 - protein, 451 aa, Artificial Sequence
  KU758876.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGVKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 794 - protein, 451 aa, Artificial Sequence
  KU926310.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGADGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 795 - protein, 451 aa, Artificial Sequence
  KU681081.3 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGS

SEQ ID NO: 796 - protein, 451 aa, Artificial Sequence
  KU744693.1 solE
SQKVIYLVMILLIAPAYSIRCIGVSNRDFVEGMSGGTWVDVVLEHGGCVTAMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMLVNDTGHETDENRAKVEITPNSPRAEATLGGFGSLGLDCEPRTGLDFSDLYYLTMNNKHWLAHKEWFHDIPLPWHAGAATGTPHWNNKEALVEFKDAHAKRQTVVVLGSQEGAVHTALAGALEAEMDGAKGRLSSGHLKCRLKMDKLRLKGVSYSLCTAAFTFTKIPAETVDGTVTVEGQYGGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 797 - protein, 451 aa, Artificial Sequence
  EU545988.1 solE
SQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 798 - protein, 451 aa, Artificial Sequence
  KY007221.1 solE
SQKVIYLVMILLIAPAYSIRCIGVNNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 799 - protein, 451 aa, Artificial Sequence
  KY003152.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCAAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 800 - protein, 451 aa, Artificial Sequence
  KX694533.2 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDIGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 801 - protein, 451 aa, Artificial Sequence
  KX601167.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGDKKITHHWYRSGSTIGKAFEATVRGAKRMAVLGDTAWDFGS

SEQ ID NO: 802 - protein, 451 aa, Artificial Sequence
  KY288905.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 803 - protein, 451 aa, Artificial Sequence
  KF268950.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 804 - protein, 451 aa, Artificial Sequence
  KF383116.1 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 805 - protein, 445 aa, Artificial Sequence
  KU963574.2 solE
SQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHSGADTETPHWNNKEALVEFKDAHAKRQTVVVLGSQEGAVHTALAGALEAEMDGAKGRLSSGHLKCRLKMDKLRLKGVSYSLCTAAFTFTKVPAETLHGTVTVEVQYAGRDGPCKVPAQMAVDMQTLTPVGRLITANPVITESTENSKMMLELDPPFGDSYIVIGVGDKKITHHWHRSGSIIGKAFEATVRGAKRMAVLGDTAWDFGS

SEQ ID NO: 806 - protein, 451 aa, Artificial Sequence
  KF383118.1 solE
SQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGS

SEQ ID NO: 807 - protein, 451 aa, Artificial Sequence
  KX520666.1 solE
RQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGS

SEQ ID NO: 808 - protein, 451 aa, Artificial Sequence
  KF383120.1 solE
SQRVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRIKMDKLRLKGVSYSLCTAAFTFSKVPAETLHGTVTVEVQYAGRDGPCKVPAQMAVDMQTLTPVGRLITANPIITESTENSRMMLELDPPFGDSYIVIGVGDKKITHHWHRSGSTIGKAFEATVRGAKRMAVLGDTAWDFGS

SEQ ID NO: 809 - RNA, 2136 nt, Artificial Sequence; identical to SEQ ID NO: 68
  ZIKV (strain ZikaSPH2015) Polyprotein(93-804) CDS wild type

SEQ ID NO: 810 - RNA, 2136 nt, Artificial Sequence; identical to SEQ ID NO: 86
  ZIKV (isolate Z1106033) Polyprotein(93-804) CDS wild type

SEQ ID NO: 811 - RNA, 2124 nt, Artificial Sequence; identical to SEQ ID NO: 104
  ZIKV (strain MR 766) Polyprotein(93-800) CDS wild type

SEQ ID NO: 812 - RNA, 2136 nt, Artificial Sequence
  ZIKV (strain NatalRGN) Polyprotein(93-804) CDS wild type
agaauaaucaaugcuaggaaggagaagaagagacgaggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 813 - RNA, 2061 nt, Artificial Sequence
  ZIKV (strain ZikaSPH2015) Polyprotein(108-794) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 814 - RNA, 2061 nt, Artificial Sequence
  ZIKV (isolate Z1106033) Polyprotein(108-794) CDS wild type
acgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 815 - RNA, 2049 nt, Artificial Sequence
  ZIKV (strain MR 766) Polyprotein(108-790) CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 816 - RNA, 2061 nt, Artificial Sequence
  ZIKV (strain NatalRGN) Polyprotein(108-794) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 817 - RNA, 1353 nt, Artificial Sequence; identical to SEQ ID NO: 69
  ZIKV (strain ZikaSPH2015) Polyprotein(273-723) CDS wild type

SEQ ID NO: 818 - RNA, 1353 nt, Artificial Sequence; identical to SEQ ID NO: 87
  ZIKV (isolate Z1106033) Polyprotein(273-723) CDS wild type

SEQ ID NO: 819 - RNA, 1341 nt, Artificial Sequence; identical to SEQ ID NO: 106
  ZIKV (strain MR 766) Polyprotein(273-719) CDS wild type

SEQ ID NO: 820 - RNA, 1353 nt, Artificial Sequence
  ZIKV (strain NatalRGN) Polyprotein(273-723) CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 821 - RNA, 2061 nt, Artificial Sequence
  ZIKV (strain ZikaSPH2015) Polyprotein(108-794)(F398S) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 822 - RNA, 2061 nt, Artificial Sequence
  ZIKV (isolate Z1106033) Polyprotein(108-794)(F398S) CDS wild type
acgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 823 - RNA, 2049 nt, Artificial Sequence
  ZIKV (strain MR 766) Polyprotein(108-790)(F398S) CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuccggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 824 - RNA, 2061 nt, Artificial Sequence
  ZIKV (strain NatalRGN) Polyprotein(108-794)(F398S) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 825 - RNA, 2061 nt, Artificial Sequence
  ZIKV (strain ZikaSPH2015) Polyprotein(108-794)(N444Q) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 826 - RNA, 2061 nt, Artificial Sequence
  ZIKV (isolate Z1106033) Polyprotein(108-794)(N444Q) CDS wild type
acgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 827 - RNA, 2061 nt, Artificial Sequence
  ZIKV (strain NatalRGN) Polyprotein(108-794)(N444Q) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 828 - RNA, 2061 nt, Artificial Sequence
  ZIKV (strain ZikaSPH2015) Polyprotein(108-694)-Cterm-JAEV1-E(400-500) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 829 - RNA, 2061 nt, Artificial Sequence
  ZIKV (isolate Z1106033) Polyprotein(108-694)-Cterm-JAEV1-E(400-500) CDS wild type
acgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 830 - RNA, 2049 nt, Artificial Sequence
  ZIKV (strain MR 766) Polyprotein(108-690)-Cterm-JAEV1-E(400-500) CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 831 - RNA, 2061 nt, Artificial Sequence
  ZIKV (strain NatalRGN) Polyprotein(108-694)-Cterm-JAEV1-E(400-500) CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 832 - RNA, 2136 nt, Artificial Sequence; identical to SEQ ID NO: 68
  ZIKV (strain ZikaSPH2015) Polyprotein(93-804) CDS wild type

SEQ ID NO: 833 - RNA, 2133 nt, Artificial Sequence
  ZIKV prME variant CDS wild type
auaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 834 - RNA, 2130 nt, Artificial Sequence
  ZIKV prME variant CDS wild type
aucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 835 - RNA, 2127 nt, Artificial Sequence
  ZIKV prME variant CDS wild type
aaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 836 - RNA, 2124 nt, Artificial Sequence
  ZIKV prME variant CDS wild type
gcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 837 - RNA, 2121 nt, Artificial Sequence
  ZIKV prME variant CDS wild type
aggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 838 - RNA, 2118 nt, Artificial Sequence
  ZIKV prME variant CDS wild type
aaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 839 - RNA, 2115 nt, Artificial Sequence
  ZIKV prME variant CDS wild type
gagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 840 - RNA, 2112 nt, Artificial Sequence
  ZIKV prME variant CDS wild type
aagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 841 - RNA, 2109 nt, Artificial Sequence
  ZIKV prME variant CDS wild type
aagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 842 - RNA, 2106 nt, Artificial Sequence
  ZIKV prME variant CDS wild type
agacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 843 - RNA, 2103 nt, Artificial Sequence
  ZIKV prME variant CDS wild type
cggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 844 - RNA, 2100 nt, Artificial Sequence
  ZIKV prME variant CDS wild type
ggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 845 - RNA, 2097 nt, Artificial Sequence
  ZIKV prME variant CDS wild type
gcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 846 - RNA, 2094 nt, Artificial Sequence
  ZIKV prME variant CDS wild type
gauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 847 - RNA, 2091 nt, Artificial Sequence
  ZIKV prME variant CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 848 - RNA, 2091 nt, Artificial Sequence
  ZIKV prME variant CDS wild type
accagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 849 - RNA, 2103 nt, Artificial Sequence
  ZIKV prME variant CDS wild type
cggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 850 - RNA, 2127 nt, Artificial Sequence
  ZIKV prME variant CDS wild type
agaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 851 - RNA, 2127 nt, Artificial Sequence
  ZIKV prME variant CDS wild type
agaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 852 - RNA, 2118 nt, Artificial Sequence
  ZIKV prME variant CDS wild type
agaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 853 - RNA, 2115 nt, Artificial Sequence
  ZIKV prME variant CDS wild type
auaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 854 - RNA, 2112 nt, Artificial Sequence
  ZIKV prME variant CDS wild type
aucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 855 - RNA, 2109 nt, Artificial Sequence
  ZIKV prME variant CDS wild type
aaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 856 - RNA, 2106 nt, Artificial Sequence
  ZIKV prME variant CDS wild type
gcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 857 - RNA, 2103 nt, Artificial Sequence
  ZIKV prME variant CDS wild type
aggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 858 - RNA, 2100 nt, Artificial Sequence
  ZIKV prME variant CDS wild type
aaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 859 - RNA, 2097 nt, Artificial Sequence
  ZIKV prME variant CDS wild type
gagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 860 - RNA, 2094 nt, Artificial Sequence
  ZIKV prME variant CDS wild type
aagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 861 - RNA, 2091 nt, Artificial Sequence
  ZIKV prME variant CDS wild type
aagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 862 - RNA, 2088 nt, Artificial Sequence
  ZIKV prME variant CDS wild type
agacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 863 - RNA, 2085 nt, Artificial Sequence
  ZIKV prME variant CDS wild type
cggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 864 - RNA, 2082 nt, Artificial Sequence
  ZIKV prME variant CDS wild type
ggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 865 - RNA, 2079 nt, Artificial Sequence
  ZIKV prME variant CDS wild type
gcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 866 - RNA, 2076 nt, Artificial Sequence
  ZIKV prME variant CDS wild type
gauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 867 - RNA, 2073 nt, Artificial Sequence
  ZIKV prME variant CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 868 - RNA, 2073 nt, Artificial Sequence
  ZIKV prME variant CDS wild type
accagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 869 - RNA, 2085 nt, Artificial Sequence
  ZIKV prME variant CDS wild type
cggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugc

SEQ ID NO: 870 - RNA, 2109 nt, Artificial Sequence
  ZIKV prME variant CDS wild type
agaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 871 - RNA, 2109 nt, Artificial Sequence
  ZIKV prME variant CDS wild type
agaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 872 - RNA, 2109 nt, Artificial Sequence
  ZIKV prME variant CDS wild type
agaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 873 - RNA, 2106 nt, Artificial Sequence
  ZIKV prME variant CDS wild type
auaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 874 - RNA, 2103 nt, Artificial Sequence
  ZIKV prME variant CDS wild type
aucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 875 - RNA, 2100 nt, Artificial Sequence
  ZIKV prME variant CDS wild type
aaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 876 - RNA, 2097 nt, Artificial Sequence
  ZIKV prME variant CDS wild type
gcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 877 - RNA, 2094 nt, Artificial Sequence
  ZIKV prME variant CDS wild type
aggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 878 - RNA, 2091 nt, Artificial Sequence
  ZIKV prME variant CDS wild type
aaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 879 - RNA, 2088 nt, Artificial Sequence
  ZIKV prME variant CDS wild type
gagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 880 - RNA, 2085 nt, Artificial Sequence
  ZIKV prME variant CDS wild type
aagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 881 - RNA, 2082 nt, Artificial Sequence
  ZIKV prME variant CDS wild type
aagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 882 - RNA, 2079 nt, Artificial Sequence
  ZIKV prME variant CDS wild type
agacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 883 - RNA, 2076 nt, Artificial Sequence
  ZIKV prME variant CDS wild type
cggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 884 - RNA, 2073 nt, Artificial Sequence
  ZIKV prME variant CDS wild type
ggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 885 - RNA, 2070 nt, Artificial Sequence
  ZIKV prME variant CDS wild type
gcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 886 - RNA, 2067 nt, Artificial Sequence
  ZIKV prME variant CDS wild type
gauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 887 - RNA, 2064 nt, Artificial Sequence
  ZIKV prME variant CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 888 - RNA, 2064 nt, Artificial Sequence
  ZIKV prME variant CDS wild type
accagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 889 - RNA, 2076 nt, Artificial Sequence
  ZIKV prME variant CDS wild type
cggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugau

SEQ ID NO: 890 - RNA, 2100 nt, Artificial Sequence
  ZIKV prME variant CDS wild type
agaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 891 - RNA, 2100 nt, Artificial Sequence
  ZIKV prME variant CDS wild type
agaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 892 - RNA, 2106 nt, Artificial Sequence
  ZIKV prME variant CDS wild type
agaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 893 - RNA, 2100 nt, Artificial Sequence
  ZIKV prME variant CDS wild type
aucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 894 - RNA, 2103 nt, Artificial Sequence
  ZIKV prME variant CDS wild type
auaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 895 - RNA, 2097 nt, Artificial Sequence
  ZIKV prME variant CDS wild type
aaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 896 - RNA, 2094 nt, Artificial Sequence
  ZIKV prME variant CDS wild type
gcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 897 - RNA, 2091 nt, Artificial Sequence
  ZIKV prME variant CDS wild type
aggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 898 - RNA, 2088 nt, Artificial Sequence
  ZIKV prME variant CDS wild type
aaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 899 - RNA, 2085 nt, Artificial Sequence
  ZIKV prME variant CDS wild type
gagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 900 - RNA, 2082 nt, Artificial Sequence
  ZIKV prME variant CDS wild type
aagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 901 - RNA, 2079 nt, Artificial Sequence
  ZIKV prME variant CDS wild type
aagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 902 - RNA, 2076 nt, Artificial Sequence
  ZIKV prME variant CDS wild type
agacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 903 - RNA, 2073 nt, Artificial Sequence
  ZIKV prME variant CDS wild type
cggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 904 - RNA, 2070 nt, Artificial Sequence
  ZIKV prME variant CDS wild type
ggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 905 - RNA, 2067 nt, Artificial Sequence
  ZIKV prME variant CDS wild type
gcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 906 - RNA, 2064 nt, Artificial Sequence
  ZIKV prME variant CDS wild type
gauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 907 - RNA, 2061 nt, Artificial Sequence; identical to SEQ ID NO: 813
  ZIKV (strain ZikaSPH2015) Polyprotein(108-794) CDS wild type

SEQ ID NO: 908 - RNA, 2061 nt, Artificial Sequence
  ZIKV prME variant CDS wild type
accagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 909 - RNA, 2073 nt, Artificial Sequence
  ZIKV prME variant CDS wild type
cggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 910 - RNA, 2097 nt, Artificial Sequence
  ZIKV prME variant CDS wild type
agaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 911 - RNA, 2097 nt, Artificial Sequence
  ZIKV prME variant CDS wild type
agaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 912 - RNA, 2136 nt, Artificial Sequence; identical to SEQ ID NO: 67
  KU321639.1 prME-long CDS wild type

SEQ ID NO: 913 - RNA, 2136 nt, Artificial Sequence; identical to SEQ ID NO: 85
  KU312312.1 prME-long CDS wild type

SEQ ID NO: 914 - RNA, 2124 nt, Artificial Sequence; identical to SEQ ID NO: 103
  AY632535.2 prME-long CDS wild type

SEQ ID NO: 915 - RNA, 2136 nt, Artificial Sequence
  KU527068.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 916 - RNA, 2136 nt, Artificial Sequence
  KU720415.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 917 - RNA, 2118 nt, Artificial Sequence
  DQ859059.1 prME-long CDS wild type
agaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaag

SEQ ID NO: 918 - RNA, 2136 nt, Artificial Sequence
  KX377335.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 919 - RNA, 2136 nt, Artificial Sequence
  LC002520.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 920 - RNA, 2124 nt, Artificial Sequence
  KU963573.2 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 921 - RNA, 2136 nt, Artificial Sequence
  KX694534.2 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 922 - RNA, 2136 nt, Artificial Sequence
  KX447520.1 prME-long CDS wild type
agaauaaucaaugcuaggaaggagaagaagagacgaggcgcagaugcuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 923 - RNA, 2136 nt, Artificial Sequence
  KX369547.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 924 - RNA, 2136 nt, Artificial Sequence
  KX447515.1 prME-long CDS wild type
agaauaaucaaugcuaggaaggagaagaagagacgaggcgcagauacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 925 - RNA, 2136 nt, Artificial Sequence
  KU501217.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 926 - RNA, 2136 nt, Artificial Sequence
  KU312314.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 927 - RNA, 2136 nt, Artificial Sequence
  KX446950.2 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 928 - RNA, 2136 nt, Artificial Sequence
  KY003157.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcugauguggggugcucgguggacuucucaaag

SEQ ID NO: 929 - RNA, 2136 nt, Artificial Sequence
  KX811222.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 930 - RNA, 2136 nt, Artificial Sequence
  KX447516.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 931 - RNA, 2136 nt, Artificial Sequence
  KX520666.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 932 - RNA, 2136 nt, Artificial Sequence
  KU729218.1 prME-long CDS wild type
agaauaaucaaugcuaggaaggagaagaagagacgaagcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 933 - RNA, 2136 nt, Artificial Sequence
  KU761561.1 prME-long CDS wild type
agaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 934 - RNA, 2136 nt, Artificial Sequence
  KY317938.1 prME-long CDS wild type
agaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 935 - RNA, 2136 nt, Artificial Sequence
  KY075939.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 936 - RNA, 2136 nt, Artificial Sequence
  KX806557.2 prME-long CDS wild type
agaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 937 - RNA, 2136 nt, Artificial Sequence
  KU870645.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 938 - RNA, 2136 nt, Artificial Sequence
  KU729217.2 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 939 - RNA, 2136 nt, Artificial Sequence
  KU497555.1 prME-long CDS wild type
agaauaaucaaugccaggaaggagaagaagagacgaggcgcagauacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 940 - RNA, 2136 nt, Artificial Sequence
  KX087101.3 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 941 - RNA, 2136 nt, Artificial Sequence
  KY075932.1 prME-long CDS wild type
agaauaaucaaugcuaggaaggagaagaagagacgaggcgcagaaacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 942 - RNA, 2136 nt, Artificial Sequence
  KY014317.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 943 - RNA, 2136 nt, Artificial Sequence
  KU758876.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcugauguggggugcucgguggacuucucaaag

SEQ ID NO: 944 - RNA, 2136 nt, Artificial Sequence
  KU758874.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaag

SEQ ID NO: 945 - RNA, 2136 nt, Artificial Sequence
  KY014314.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaag

SEQ ID NO: 946 - RNA, 2136 nt, Artificial Sequence
  KU926310.1 prME-long CDS wild type
agaauaaucaaugcuaggaaggagaagaagagacgaggcgcagauacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 947 - RNA, 2136 nt, Artificial Sequence
  KU761560.1 prME-long CDS wild type
agaauaaucaaugcugggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacguucaccaagaucccggcugaaacacugcacgggacagucacaguggagguacaguacgcagggacagauggaccuugcaagguuccagcucagauggcgguggacaugcaaacucugaccccaguugggaggcugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 948 - RNA, 2136 nt, Artificial Sequence
  KY317939.1 prME-long CDS wild type
agaauaaucaaugcuaggaaggagaagaagagacgaggcgcagaaacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 949 - RNA, 2136 nt, Artificial Sequence
  KY075937.1 prME-long CDS wild type
agaauaaucaaugcuaggaaggagaagaagagacgaggcgcagauacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcugauguggggugcucgguggacuucucaaag

SEQ ID NO: 950 - RNA, 2136 nt, Artificial Sequence
  LC191864.1 prME-long CDS wild type
agaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcugauguggggugcucgguggacuucucaaag

SEQ ID NO: 951 - RNA, 2136 nt, Artificial Sequence
  KX447517.1 prME-long CDS wild type
agaauaaucaaugccaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 952 - RNA, 2136 nt, Artificial Sequence
  KU922923.1 prME-long CDS wild type
agaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 953 - RNA, 2136 nt, Artificial Sequence
  KY003156.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaag

SEQ ID NO: 954 - RNA, 2136 nt, Artificial Sequence
  KU312313.1 prME-long CDS wild type
agaauaaucaaugcuaggaaggagaagaagagacgaggcgcagauacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaag

SEQ ID NO: 955 - RNA, 2136 nt, Artificial Sequence
  KY075935.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaag

SEQ ID NO: 956 - RNA, 2136 nt, Artificial Sequence
  KY014320.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaag

SEQ ID NO: 957 - RNA, 2136 nt, Artificial Sequence
  KX827309.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcugauguggggugcucgguggacuucucaaag

SEQ ID NO: 958 - RNA, 2136 nt, Artificial Sequence
  KU681081.3 prME-long CDS wild type
agaauaaucaaugcuaggaaggagaagaagagacgaggcacagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcugauguggggugcucgguggacuucucaaag

SEQ ID NO: 959 - RNA, 2136 nt, Artificial Sequence
  KU744693.1 prME-long CDS wild type
agaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucaggugguguggggugcucgguggacuucucaaag

SEQ ID NO: 960 - RNA, 2136 nt, Artificial Sequence
  KY328290.1 prME-long CDS wild type
agaauaaucaaugcuaggaaggagaagaagagacgaggcacagauacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaag

SEQ ID NO: 961 - RNA, 2136 nt, Artificial Sequence
  KX694532.2 prME-long CDS wild type
agaauaaucaaugccaggaaggagaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuagcagcagcugccaucgcuuggcucuugggaagcucaacgagccaaaaagucauauacuuggucaugauacugcugauugcuccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggcgaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaauucaaggaugcacaugccaaaaggcaaacugucgugguucuagggagucaagagggagcaguucacacggcccuugcuggagcucuggaggcugagauggauggugcaaagggaaggcuguccucuggccacuugaaaugucgccugaaaauggauaaacuuagauugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaag

SEQ ID NO: 962 - RNA, 2136 nt, Artificial Sequence
  KU955593.1 prME-long CDS wild type
agaauaaucaaugcuaggaaggagaagaagagacgaggcacagauacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcugauguggggugcucgguggacuucucaaag

SEQ ID NO: 963 - RNA, 2136 nt, Artificial Sequence
  KY272987.1 prME-long CDS wild type
agaauaaucaaugcuaggaaggaaaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcugauguggggugcucgguggacuucucaaag

SEQ ID NO: 964 - RNA, 2136 nt, Artificial Sequence
  EU545988.1 prME-long CDS wild type
agaauaaucaaugcuaggaaggagaagaagagacgaggcacagauacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcugauguggggugcucgguggacuucucaaag

SEQ ID NO: 965 - RNA, 2136 nt, Artificial Sequence
  KU681082.3 prME-long CDS wild type
agaauaaucaaugcuaggaaggagaagaagagacgaggcgcagauacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcugauguggggugcucgguggacuucucaaag

SEQ ID NO: 966 - RNA, 2136 nt, Artificial Sequence
  KX601167.1 prME-long CDS wild type
agaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaag

SEQ ID NO: 967 - RNA, 2136 nt, Artificial Sequence
  KX694533.2 prME-long CDS wild type
agaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaag

SEQ ID NO: 968 - RNA, 2136 nt, Artificial Sequence
  KY288905.1 prME-long CDS wild type
agaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaag

SEQ ID NO: 969 - RNA, 2136 nt, Artificial Sequence
  KF268950.1 prME-long CDS wild type
agaauaaucaaugcuaggaaggagaggaagagacguggugcagacaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaag

SEQ ID NO: 970 - RNA, 2136 nt, Artificial Sequence
  KF383121.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 971 - RNA, 2118 nt, Artificial Sequence
  KF268949.1 prME-long CDS wild type
agaauaaucaaugcuaggaaggagaggaagagacguggugcagacaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaag

SEQ ID NO: 972 - RNA, 2136 nt, Artificial Sequence
  KU955595.1 prME-long CDS wild type
agaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaag

SEQ ID NO: 973 - RNA, 2136 nt, Artificial Sequence
  KF383116.1 prME-long CDS wild type
agaauuaucaaugcuaggaaggagaggaagagacguggcgcugacaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcugauguugggugcucgguggacuucucaaag

SEQ ID NO: 974 - RNA, 2118 nt, Artificial Sequence
  KU963574.2 prME-long CDS wild type
agaauaaucaaugcuaggaaggagaggaagagacguggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcugaugugggguguucgguggacuucucaaag

SEQ ID NO: 975 - RNA, 2118 nt, Artificial Sequence
  KX601166.1 prME-long CDS wild type
agaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaag

SEQ ID NO: 976 - RNA, 2136 nt, Artificial Sequence
  KF383118.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaag

SEQ ID NO: 977 - RNA, 2130 nt, Artificial Sequence
  KF383120.1 prME-long CDS wild type
agaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcagacguggggugcucaguugacuuc

SEQ ID NO: 978 - RNA, 2061 nt, Artificial Sequence
  KU321639.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 979 - RNA, 2061 nt, Artificial Sequence
  KU312312.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 980 - RNA, 2049 nt, Artificial Sequence
  AY632535.2 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 981 - RNA, 2061 nt, Artificial Sequence
  KU527068.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 982 - RNA, 2061 nt, Artificial Sequence
  KX421193.1 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 983 - RNA, 2061 nt, Artificial Sequence
  KX377335.1 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 984 - RNA, 2061 nt, Artificial Sequence
  LC002520.1 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 985 - RNA, 2043 nt, Artificial Sequence
  DQ859059.1 prME-short CDS wild type
accagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcu

SEQ ID NO: 986 - RNA, 2049 nt, Artificial Sequence
  KU963573.2 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 987 - RNA, 2061 nt, Artificial Sequence
  KX694534.2 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 988 - RNA, 2061 nt, Artificial Sequence
  KX369547.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 989 - RNA, 2061 nt, Artificial Sequence
  KX447515.1 prME-short CDS wild type
acuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 990 - RNA, 2061 nt, Artificial Sequence
  KU729218.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 991 - RNA, 2061 nt, Artificial Sequence
  KU501217.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 992 - RNA, 2061 nt, Artificial Sequence
  KU312314.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 993 - RNA, 2061 nt, Artificial Sequence
  KX446950.2 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 994 - RNA, 2061 nt, Artificial Sequence
  KY003157.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcu

SEQ ID NO: 995 - RNA, 2061 nt, Artificial Sequence
  KX811222.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 996 - RNA, 2061 nt, Artificial Sequence
  KX447516.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcu

SEQ ID NO: 997 - RNA, 2061 nt, Artificial Sequence
  KX520666.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 998 - RNA, 2061 nt, Artificial Sequence
  KU497555.1 prME-short CDS wild type
acuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 999 - RNA, 2061 nt, Artificial Sequence
  KY075939.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1000 - RNA, 2061 nt, Artificial Sequence
  KY075932.1 prME-short CDS wild type
acuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1001 - RNA, 2061 nt, Artificial Sequence
  KU870645.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1002 - RNA, 2061 nt, Artificial Sequence
  KU729217.2 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 1003 - RNA, 2061 nt, Artificial Sequence
  KX087101.3 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1004 - RNA, 2061 nt, Artificial Sequence
  KY014317.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcu

SEQ ID NO: 1005 - RNA, 2061 nt, Artificial Sequence
  KU758876.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcu

SEQ ID NO: 1006 - RNA, 2061 nt, Artificial Sequence
  KU758874.1 prME-short CDS wild type
acuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcu

SEQ ID NO: 1007 - RNA, 2061 nt, Artificial Sequence
  KY317939.1 prME-short CDS wild type
acuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1008 - RNA, 2061 nt, Artificial Sequence
  KY014314.1 prME-short CDS wild type
acuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcu

SEQ ID NO: 1009 - RNA, 2061 nt, Artificial Sequence
  KX447517.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcu

SEQ ID NO: 1010 - RNA, 2061 nt, Artificial Sequence
  KU926310.1 prME-short CDS wild type
acuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 1011 - RNA, 2061 nt, Artificial Sequence
  KU922923.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1012 - RNA, 2061 nt, Artificial Sequence
  KY075937.1 prME-short CDS wild type
acuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcu

SEQ ID NO: 1013 - RNA, 2061 nt, Artificial Sequence
  KY003156.1 prME-short CDS wild type
acuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcu

SEQ ID NO: 1014 - RNA, 2061 nt, Artificial Sequence
  KU312313.1 prME-short CDS wild type
acuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 1015 - RNA, 2061 nt, Artificial Sequence
  KY075935.1 prME-short CDS wild type
acuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcu

SEQ ID NO: 1016 - RNA, 2061 nt, Artificial Sequence
  KY014320.1 prME-short CDS wild type
acuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1017 - RNA, 2061 nt, Artificial Sequence
  KY328290.1 prME-short CDS wild type
acuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcu

SEQ ID NO: 1018 - RNA, 2061 nt, Artificial Sequence
  KU681081.3 prME-short CDS wild type
acuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcu

SEQ ID NO: 1019 - RNA, 2061 nt, Artificial Sequence
  KX827309.1 prME-short CDS wild type
acuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcu

SEQ ID NO: 1020 - RNA, 2061 nt, Artificial Sequence
  KU955593.1 prME-short CDS wild type
acuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcu

SEQ ID NO: 1021 - RNA, 2061 nt, Artificial Sequence
  KY272987.1 prME-short CDS wild type
acuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcu

SEQ ID NO: 1022 - RNA, 2061 nt, Artificial Sequence
  KY007221.1 prME-short CDS wild type
acuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcu

SEQ ID NO: 1023 - RNA, 2061 nt, Artificial Sequence
  EU545988.1 prME-short CDS wild type
acuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcu

SEQ ID NO: 1024 - RNA, 2061 nt, Artificial Sequence
  KU681082.3 prME-short CDS wild type
acuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcu

SEQ ID NO: 1025 - RNA, 2061 nt, Artificial Sequence
  KX601167.1 prME-short CDS wild type
accagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcu

SEQ ID NO: 1026 - RNA, 2061 nt, Artificial Sequence
  KX694533.2 prME-short CDS wild type
accagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcu

SEQ ID NO: 1027 - RNA, 2061 nt, Artificial Sequence
  KY288905.1 prME-short CDS wild type
accagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcu

SEQ ID NO: 1028 - RNA, 2061 nt, Artificial Sequence
  KF268950.1 prME-short CDS wild type
accagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcu

SEQ ID NO: 1029 - RNA, 2061 nt, Artificial Sequence
  KF383121.1 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 1030 - RNA, 2043 nt, Artificial Sequence
  KF268949.1 prME-short CDS wild type
accagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcu

SEQ ID NO: 1031 - RNA, 2061 nt, Artificial Sequence
  KU955595.1 prME-short CDS wild type
accagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcu

SEQ ID NO: 1032 - RNA, 2061 nt, Artificial Sequence
  KF383116.1 prME-short CDS wild type
accagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcu

SEQ ID NO: 1033 - RNA, 2043 nt, Artificial Sequence
  KX601166.1 prME-short CDS wild type
accagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcu

SEQ ID NO: 1034 - RNA, 2061 nt, Artificial Sequence
  KF383118.1 prME-short CDS wild type
accagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 1035 - RNA, 2058 nt, Artificial Sequence
  KX447520.1 prME-short CDS wild type
agugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1036 - RNA, 2061 nt, Artificial Sequence
  KU761561.1 prME-short CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1037 - RNA, 2061 nt, Artificial Sequence
  KX806557.2 prME-short CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 1038 - RNA, 2061 nt, Artificial Sequence
  LC191864.1 prME-short CDS wild type
accagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcu

SEQ ID NO: 1039 - RNA, 2061 nt, Artificial Sequence
  KU744693.1 prME-short CDS wild type
acuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucaggu

SEQ ID NO: 1040 - RNA, 2052 nt, Artificial Sequence
  KU963574.2 prME-short CDS wild type
ggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcu

SEQ ID NO: 1041 - RNA, 2070 nt, Artificial Sequence
  KF383120.1 prME-short CDS wild type
ggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggca

SEQ ID NO: 1042 - RNA, 1353 nt, Artificial Sequence; identical to SEQ ID NO: 69
  KU321639.1 solE CDS wild type

SEQ ID NO: 1043 - RNA, 1353 nt, Artificial Sequence; identical to SEQ ID NO: 87
  KU312312.1 solE CDS wild type

SEQ ID NO: 1044 - RNA, 1341 nt, Artificial Sequence; identical to SEQ ID NO: 105
  AY632535.2 solE CDS wild type

SEQ ID NO: 1045 - RNA, 1353 nt, Artificial Sequence; identical to SEQ ID NO: 820
  KU527068.1 solE CDS wild type

SEQ ID NO: 1046 - RNA, 1353 nt, Artificial Sequence
  KX421193.1 solE CDS wild type
agccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggauca

SEQ ID NO: 1047 - RNA, 1353 nt, Artificial Sequence
  LC002520.1 solE CDS wild type
agccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggauca

SEQ ID NO: 1048 - RNA, 1335 nt, Artificial Sequence
  DQ859059.1 solE CDS wild type
agccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggauca

SEQ ID NO: 1049 - RNA, 1341 nt, Artificial Sequence
  KU963573.2 solE CDS wild type
agccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggauca

SEQ ID NO: 1050 - RNA, 1353 nt, Artificial Sequence
  KY075939.1 solE CDS wild type
agccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1051 - RNA, 1353 nt, Artificial Sequence
  KX447516.1 solE CDS wild type
agcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1052 - RNA, 1353 nt, Artificial Sequence
  KX447515.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggauca

SEQ ID NO: 1053 - RNA, 1353 nt, Artificial Sequence
  KU758874.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1054 - RNA, 1353 nt, Artificial Sequence
  KU729218.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1055 - RNA, 1353 nt, Artificial Sequence
  KU501217.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1056 - RNA, 1353 nt, Artificial Sequence
  KU761561.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggauca

SEQ ID NO: 1057 - RNA, 1353 nt, Artificial Sequence
  KY075937.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1058 - RNA, 1353 nt, Artificial Sequence
  KY014317.1 solE CDS wild type
agccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1059 - RNA, 1353 nt, Artificial Sequence
  KU870645.1 solE CDS wild type
agccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggauca

SEQ ID NO: 1060 - RNA, 1353 nt, Artificial Sequence
  KU922923.1 solE CDS wild type
agccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1061 - RNA, 1353 nt, Artificial Sequence
  KU497555.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1062 - RNA, 1353 nt, Artificial Sequence
  KU312314.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1063 - RNA, 1353 nt, Artificial Sequence
  KY014314.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1064 - RNA, 1353 nt, Artificial Sequence
  KX447517.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1065 - RNA, 1353 nt, Artificial Sequence
  KU729217.2 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1066 - RNA, 1353 nt, Artificial Sequence
  KY328290.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1067 - RNA, 1353 nt, Artificial Sequence
  KX087101.3 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1068 - RNA, 1353 nt, Artificial Sequence
  KY003156.1 solE CDS wild type
agccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1069 - RNA, 1353 nt, Artificial Sequence
  KU758876.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggauca

SEQ ID NO: 1070 - RNA, 1353 nt, Artificial Sequence
  KU926310.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1071 - RNA, 1353 nt, Artificial Sequence
  KU681081.3 solE CDS wild type
agccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1072 - RNA, 1353 nt, Artificial Sequence
  KU744693.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1073 - RNA, 1353 nt, Artificial Sequence
  EU545988.1 solE CDS wild type
agccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggauca

SEQ ID NO: 1074 - RNA, 1353 nt, Artificial Sequence
  KY007221.1 solE CDS wild type
agccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1075 - RNA, 1353 nt, Artificial Sequence
  KY003152.1 solE CDS wild type
agccaaaaagucauauauuuggucaugauacugcugauugccccggcauacagcaucaggugcauaggagucagcaauagggacuuuguggaagguaugucaggugggacuuggguugauguugucuuggaacauggaggcuguguuaccguaauggcacaggacaaaccgacugucgacauagagcugguuacaacaacaguuagcaacauggcggagguaagauccuacugcuaugaggcaucaauaucggauauggcuucggacagccgcugcccaacacaaggugaggccuaccuugacaagcagucagacacucaauaugucugcaaaagaacguuaguggauagaggcuggggaaauggauguggacuuuuuggaaaagggagccuggugacaugcgcuaaguuugcaugcuccaagaaaaugaccgggaagagcauccagccagagaaccuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggugugucauacuccuugugugcugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1076 - RNA, 1353 nt, Artificial Sequence
  KX694533.2 solE CDS wild type
agccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggauca

SEQ ID NO: 1077 - RNA, 1353 nt, Artificial Sequence
  KX601167.1 solE CDS wild type
agccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggauca

SEQ ID NO: 1078 - RNA, 1353 nt, Artificial Sequence
  KY288905.1 solE CDS wild type
agccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggauca

SEQ ID NO: 1079 - RNA, 1353 nt, Artificial Sequence
  KF268950.1 solE CDS wild type
agccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggauca

SEQ ID NO: 1080 - RNA, 1353 nt, Artificial Sequence
  KF383116.1 solE CDS wild type
agccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggauca

SEQ ID NO: 1081 - RNA, 1335 nt, Artificial Sequence
  KU963574.2 solE CDS wild type
agccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggauca

SEQ ID NO: 1082 - RNA, 1353 nt, Artificial Sequence
  KF383118.1 solE CDS wild type
agccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggauca

SEQ ID NO: 1083 - RNA, 1353 nt, Artificial Sequence
  KX520666.1 solE CDS wild type
cgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggauca

SEQ ID NO: 1084 - RNA, 1353 nt, Artificial Sequence
  KF383120.1 solE CDS wild type
agccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucu

SEQ ID NO: 1085 - RNA, 2136 nt, Artificial Sequence; identical to SEQ ID NO: 122
  ZIKV (strain ZikaSPH2015) Polyprotein(93-804) CDS GC

SEQ ID NO: 1086 - RNA, 2136 nt, Artificial Sequence; identical to SEQ ID NO: 141
  ZIKV (isolate Z1106033) Polyprotein(93-804) CDS GC

SEQ ID NO: 1087 - RNA, 2124 nt, Artificial Sequence; identical to SEQ ID NO: 160
  ZIKV (strain MR 766) Polyprotein(93-800) CDS GC

SEQ ID NO: 1088 - RNA, 2136 nt, Artificial Sequence
  ZIKV (strain NatalRGN) Polyprotein(93-804) CDS GC
cggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccgacgucgggugcuccguggacuucagcaag

SEQ ID NO: 1089 - RNA, 2061 nt, Artificial Sequence
  ZIKV (strain ZikaSPH2015) Polyprotein(108-794) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1090 - RNA, 2061 nt, Artificial Sequence
  ZIKV (isolate Z1106033) Polyprotein(108-794) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 1091 - RNA, 2049 nt, Artificial Sequence
  ZIKV (strain MR 766) Polyprotein(108-790) CDS GC
accagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 1092 - RNA, 2061 nt, Artificial Sequence
  ZIKV (strain NatalRGN) Polyprotein(108-794) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 1093 - RNA, 1353 nt, Artificial Sequence; identical to SEQ ID NO: 124
  ZIKV (strain ZikaSPH2015) Polyprotein(273-723) CDS GC

SEQ ID NO: 1094 - RNA, 1353 nt, Artificial Sequence; identical to SEQ ID NO: 143
  ZIKV (isolate Z1106033) Polyprotein(273-723) CDS GC

SEQ ID NO: 1095 - RNA, 1341 nt, Artificial Sequence; identical to SEQ ID NO: 162
  ZIKV (strain MR 766) Polyprotein(273-719) CDS GC

SEQ ID NO: 1096 - RNA, 1353 nt, Artificial Sequence
  ZIKV (strain NatalRGN) Polyprotein(273-723) CDS GC
agccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagc

SEQ ID NO: 1097 - RNA, 2061 nt, Artificial Sequence
  ZIKV (strain ZikaSPH2015) Polyprotein(108-794)(F398S) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuccgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1098 - RNA, 2061 nt, Artificial Sequence
  ZIKV (isolate Z1106033) Polyprotein(108-794)(F398S) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 1099 - RNA, 2049 nt, Artificial Sequence
  ZIKV (strain MR 766) Polyprotein(108-790)(F398S) CDS GC
accagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguccggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 1100 - RNA, 2061 nt, Artificial Sequence
  ZIKV (strain NatalRGN) Polyprotein(108-794)(F398S) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 1101 - RNA, 2061 nt, Artificial Sequence
  ZIKV (strain ZikaSPH2015) Polyprotein(108-794)(N444Q) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucguccaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1102 - RNA, 2061 nt, Artificial Sequence
  ZIKV (isolate Z1106033) Polyprotein(108-794)(N444Q) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 1103 - RNA, 2061 nt, Artificial Sequence
  ZIKV (strain NatalRGN) Polyprotein(108-794)(N444Q) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 1104 - RNA, 2061 nt, Artificial Sequence
  ZIKV (strain ZikaSPH2015) Polyprotein(108-694)-Cterm-JAEV1-E(400-500) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 1105 - RNA, 2061 nt, Artificial Sequence
  ZIKV (isolate Z1106033) Polyprotein(108-694)-Cterm-JAEV1-E(400-500) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 1106 - RNA, 2049 nt, Artificial Sequence
  ZIKV (strain MR 766) Polyprotein(108-690)-Cterm-JAEV1-E(400-500) CDS GC
accagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 1107 - RNA, 2061 nt, Artificial Sequence
  ZIKV (strain NatalRGN) Polyprotein(108-694)-Cterm-JAEV1-E(400-500) CDS GC
accagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 1108 - RNA, 2136 nt, Artificial Sequence
  ZIKV (strain ZikaSPH2015) Polyprotein(93-804) CDS GC
cggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1109 - RNA, 2133 nt, Artificial Sequence
  ZIKV prME variant CDS GC
aucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1110 - RNA, 2130 nt, Artificial Sequence
  ZIKV prME variant CDS GC
aucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1111 - RNA, 2127 nt, Artificial Sequence
  ZIKV prME variant CDS GC
aacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1112 - RNA, 2124 nt, Artificial Sequence
  ZIKV prME variant CDS GC
gcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1113 - RNA, 2121 nt, Artificial Sequence
  ZIKV prME variant CDS GC
cgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1114 - RNA, 2118 nt, Artificial Sequence
  ZIKV prME variant CDS GC
aaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1115 - RNA, 2115 nt, Artificial Sequence
  ZIKV prME variant CDS GC
gagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1116 - RNA, 2112 nt, Artificial Sequence
  ZIKV prME variant CDS GC
aagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1117 - RNA, 2109 nt, Artificial Sequence
  ZIKV prME variant CDS GC
aagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1118 - RNA, 2106 nt, Artificial Sequence
  ZIKV prME variant CDS GC
cggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1119 - RNA, 2103 nt, Artificial Sequence
  ZIKV prME variant CDS GC
cgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1120 - RNA, 2100 nt, Artificial Sequence
  ZIKV prME variant CDS GC
ggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1121 - RNA, 2097 nt, Artificial Sequence
  ZIKV prME variant CDS GC
gccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1122 - RNA, 2094 nt, Artificial Sequence
  ZIKV prME variant CDS GC
gacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1123 - RNA, 2091 nt, Artificial Sequence
  ZIKV prME variant CDS GC
accagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1124 - RNA, 2091 nt, Artificial Sequence
  ZIKV prME variant CDS GC
accagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1125 - RNA, 2103 nt, Artificial Sequence
  ZIKV prME variant CDS GC
cgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1126 - RNA, 2127 nt, Artificial Sequence
  ZIKV prME variant CDS GC
cggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1127 - RNA, 2127 nt, Artificial Sequence
  ZIKV prME variant CDS GC
cggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaag

SEQ ID NO: 1128 - RNA, 2118 nt, Artificial Sequence
  ZIKV prME variant CDS GC
cggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1129 - RNA, 2115 nt, Artificial Sequence
  ZIKV prME variant CDS GC
aucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1130 - RNA, 2112 nt, Artificial Sequence
  ZIKV prME variant CDS GC
aucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1131 - RNA, 2109 nt, Artificial Sequence
  ZIKV prME variant CDS GC
aacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1132 - RNA, 2106 nt, Artificial Sequence
  ZIKV prME variant CDS GC
gcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1133 - RNA, 2103 nt, Artificial Sequence
  ZIKV prME variant CDS GC
cgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1134 - RNA, 2100 nt, Artificial Sequence
  ZIKV prME variant CDS GC
aaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1135 - RNA, 2097 nt, Artificial Sequence
  ZIKV prME variant CDS GC
gagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1136 - RNA, 2094 nt, Artificial Sequence
  ZIKV prME variant CDS GC
aagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1137 - RNA, 2091 nt, Artificial Sequence
  ZIKV prME variant CDS GC
aagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1138 - RNA, 2088 nt, Artificial Sequence
  ZIKV prME variant CDS GC
cggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1139 - RNA, 2085 nt, Artificial Sequence
  ZIKV prME variant CDS GC
cgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1140 - RNA, 2082 nt, Artificial Sequence
  ZIKV prME variant CDS GC
ggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1141 - RNA, 2079 nt, Artificial Sequence
  ZIKV prME variant CDS GC
gccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1142 - RNA, 2076 nt, Artificial Sequence
  ZIKV prME variant CDS GC
gacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1143 - RNA, 2073 nt, Artificial Sequence
  ZIKV prME variant CDS GC
accagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1144 - RNA, 2073 nt, Artificial Sequence
  ZIKV prME variant CDS GC
accagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1145 - RNA, 2085 nt, Artificial Sequence
  ZIKV prME variant CDS GC
cgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1146 - RNA, 2109 nt, Artificial Sequence
  ZIKV prME variant CDS GC
cggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1147 - RNA, 2109 nt, Artificial Sequence
  ZIKV prME variant CDS GC
cggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugc

SEQ ID NO: 1148 - RNA, 2109 nt, Artificial Sequence
  ZIKV prME variant CDS GC
cggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1149 - RNA, 2106 nt, Artificial Sequence
  ZIKV prME variant CDS GC
aucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1150 - RNA, 2103 nt, Artificial Sequence
  ZIKV prME variant CDS GC
aucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1151 - RNA, 2100 nt, Artificial Sequence
  ZIKV prME variant CDS GC
aacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1152 - RNA, 2097 nt, Artificial Sequence
  ZIKV prME variant CDS GC
gcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1153 - RNA, 2094 nt, Artificial Sequence
  ZIKV prME variant CDS GC
cgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1154 - RNA, 2091 nt, Artificial Sequence
  ZIKV prME variant CDS GC
aaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1155 - RNA, 2088 nt, Artificial Sequence
  ZIKV prME variant CDS GC
gagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1156 - RNA, 2085 nt, Artificial Sequence
  ZIKV prME variant CDS GC
aagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1157 - RNA, 2082 nt, Artificial Sequence
  ZIKV prME variant CDS GC
aagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1158 - RNA, 2079 nt, Artificial Sequence
  ZIKV prME variant CDS GC
cggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1159 - RNA, 2076 nt, Artificial Sequence
  ZIKV prME variant CDS GC
cgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1160 - RNA, 2073 nt, Artificial Sequence
  ZIKV prME variant CDS GC
ggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1161 - RNA, 2070 nt, Artificial Sequence
  ZIKV prME variant CDS GC
gccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1162 - RNA, 2067 nt, Artificial Sequence
  ZIKV prME variant CDS GC
gacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1163 - RNA, 2064 nt, Artificial Sequence
  ZIKV prME variant CDS GC
accagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1164 - RNA, 2064 nt, Artificial Sequence
  ZIKV prME variant CDS GC
accagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1165 - RNA, 2076 nt, Artificial Sequence
  ZIKV prME variant CDS GC
cgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1166 - RNA, 2100 nt, Artificial Sequence
  ZIKV prME variant CDS GC
cggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1167 - RNA, 2100 nt, Artificial Sequence
  ZIKV prME variant CDS GC
cggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgac

SEQ ID NO: 1168 - RNA, 2106 nt, Artificial Sequence
  ZIKV prME variant CDS GC
cggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1169 - RNA, 2100 nt, Artificial Sequence
  ZIKV prME variant CDS GC
aucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1170 - RNA, 2103 nt, Artificial Sequence
  ZIKV prME variant CDS GC
aucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1171 - RNA, 2097 nt, Artificial Sequence
  ZIKV prME variant CDS GC
aacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1172 - RNA, 2094 nt, Artificial Sequence
  ZIKV prME variant CDS GC
gcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1173 - RNA, 2091 nt, Artificial Sequence
  ZIKV prME variant CDS GC
cgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1174 - RNA, 2088 nt, Artificial Sequence
  ZIKV prME variant CDS GC
aaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1175 - RNA, 2085 nt, Artificial Sequence
  ZIKV prME variant CDS GC
gagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1176 - RNA, 2082 nt, Artificial Sequence
  ZIKV prME variant CDS GC
aagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1177 - RNA, 2079 nt, Artificial Sequence
  ZIKV prME variant CDS GC
aagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1178 - RNA, 2076 nt, Artificial Sequence
  ZIKV prME variant CDS GC
cggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1179 - RNA, 2073 nt, Artificial Sequence
  ZIKV prME variant CDS GC
cgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1180 - RNA, 2070 nt, Artificial Sequence
  ZIKV prME variant CDS GC
ggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1181 - RNA, 2067 nt, Artificial Sequence
  ZIKV prME variant CDS GC
gccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1182 - RNA, 2064 nt, Artificial Sequence
  ZIKV prME variant CDS GC
gacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1183 - RNA, 2061 nt, Artificial Sequence
  ZIKV (strain ZikaSPH2015) Polyprotein(108-794) CDS GC
accagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1184 - RNA, 2061 nt, Artificial Sequence
  ZIKV prME variant CDS GC
accagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1185 - RNA, 2073 nt, Artificial Sequence
  ZIKV prME variant CDS GC
cgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1186 - RNA, 2097 nt, Artificial Sequence
  ZIKV prME variant CDS GC
cggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1187 - RNA, 2097 nt, Artificial Sequence
  ZIKV prME variant CDS GC
cggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 1188 - RNA, 2136 nt, Artificial Sequence; identical to SEQ ID NO: 122
  KU321639.1 prME-long CDS GC

SEQ ID NO: 1189 - RNA, 2136 nt, Artificial Sequence; identical to SEQ ID NO: 141
  KU312312.1 prME-long CDS GC

SEQ ID NO: 1190 - RNA, 2124 nt, Artificial Sequence; identical to SEQ ID NO: 160
  AY632535.2 prME-long CDS GC

SEQ ID NO: 1191 - RNA, 2136 nt, Artificial Sequence; identical to SEQ ID NO: 1088
  KU527068.1 prME-long CDS GC

SEQ ID NO: 1192 - RNA, 2136 nt, Artificial Sequence
  KU720415.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaag

SEQ ID NO: 1193 - RNA, 2118 nt, Artificial Sequence
  DQ859059.1 prME-long CDS GC
cgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacacggggaccccgcacuggaacaacaaggaggcccugguggaguucaaggacgcccacgccaagcggcagaccgucguggugcucggcagccaggagggggcgguccacaccgcccuggccggcgcccuggaggcggagauggacggggccaagggccgccucuucuccggccaccugaagugccggcugaagauggacaagcuccgccugaagggggugagcuacucccugugcacggccgccuucaccuucaccaaggugcccgccgagacccuccacggcaccgucacgguggaggugcaguacgcggggaccgacggccccugcaagguccccgcccagauggccguggacaugcagacccugaccccggugggccggcugaucacggccaaccccgucaucaccgagagcaccgagaacuccaagaugaugcucgagcuggacccgcccuucggggacagcuacaucgugaucggcgugggggacaagaagaucacccaccacuggcaccgcuccggcagcacgaucgggaaggccuucgaggcgaccguccggggcgccaagcgcauggccgugcugggcgacaccgccugggacuucgggagcgugggcggggucuucaacucccucggcaaggggauccaccagaucuucggcgccgcguucaagagccuguucggcgggauguccugguucagccagauccugaucggcacccugcucguguggcuggggcugaacacgaagaacggcuccaucagccugaccugccuggcccucgggggcgugaugaucuuccucuccaccgccgucagcgccgacgugggcugcuccguggacuucagcaag

SEQ ID NO: 1194 - RNA, 2136 nt, Artificial Sequence
  KX377335.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccgcaagaagggcgaggcccggcgcagccggcgcgcggugacccuccccucccacagcacccggaagcugcagacccgcucccagacguggcuggagagccgggaguacaccaagcaccucaucaaggucgagaacuggaucuuccgcaaccccggguucgcccugguggccguggccaucgccuggcugcucggcuccagcaccucccagaaggucaucuaccuggugaugauccugcucaucgcgcccgccuacagcauccggugcaucgggguguccaaccgcgacuucgucgagggcaugagcggcgggaccuggguggacgugguccuggagcacggcgggugcgugacggugauggcccaggacaagccgaccgucgacaucgagcuggugaccaccacgguguccaacauggccgagguccggagcuacugcuacgaggccuccaucagcgacauggcgagcgacucccgcugccccacccagggcgaggccuaccucgacaagcagagcgacacccaguacgugugcaagcggacccugguggaccgcggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgggccaagguggaggugacccccaacuccccgcgcgccgaggcgacccucgggggcuucgggagccugggccuggacugcgagccccggaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcgccagaccguggucgugcucgggagccaggagggcgccgugcacacggcccuggccggggcgcuggaggccgagauggacggcgccaagggcaagcuguucuccgggcaccucaagugccggcugaagauggacaagcuccgccugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcggcugaucaccgccaaccccgugaucaccgagagcaccgagaacuccaagaugaugcucgagcuggacccgcccuucggcgacagcuacaucgucaucggggugggcgacaagaagaucacgcaccacuggcaccgcuccgggagcaccaucggcaaggccuucgaggcgaccgugcggggcgccaagcgcauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaag

SEQ ID NO: 1195 - RNA, 2136 nt, Artificial Sequence
  LC002520.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaccgucaacgacaucggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaag

SEQ ID NO: 1196 - RNA, 2124 nt, Artificial Sequence
  KU963573.2 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucggcuacgagaccgacgagaaccgcgccaaggucgaggugacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggcaagcuguucuccgggcaccucaagugccgccugaagauggacaagcuccggcugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcgccugaucacggccaaccccgugaucaccgagagcaccgagaacuccaagaugaugcucgagcuggacccgcccuucggcgacagcuacaucgugaucggggucggcgacaagaagaucacccaccacuggcaccgguccgggagcacgaucggcaaggccuucgaggcgaccgugcgcggcgccaagcggauggccgugcugggggacaccgccugggacuucggcagcgucgggggcguguucaacucccucgggaagggcauccaccagaucuucggcgccgcguucaagagccuguucgggggcauguccugguucagccagauccugaucgggacccugcucguguggcugggccugaacacgaagaacggguccaucagccugaccugccucgcccugggcggcgucaugaucuuccucuccaccgccgugagcgccgacguggggugcuccgucgacuucagcaag

SEQ ID NO: 1197 - RNA, 2136 nt, Artificial Sequence
  KX694534.2 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggcggggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1198 - RNA, 2136 nt, Artificial Sequence
  KX447520.1 prME-long CDS GC
cgcaucaucaacgcccggaaggagaagaagcgccggggcgccgacgcgagcguggggaucgucggccugcuccugaccaccgccauggccgccgaggugacgcgccggggguccgccuacuacauguaccuggaccgcaacgacgcgggcgaggccaucagcuuccccaccacccucgggaugaacaagugcuacauccagaucauggaccugggccacaugugcgacgccaccauguccuacgagugcccgaugcuggacgagggcguggagcccgacgacgucgacugcuggugcaacacgaccagcaccugggugguguacgggaccugccaccacaagaagggcgaggcccggcgcucccggcgcgcggucacgcuccccagccacuccacccggaagcugcagacccgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaag

SEQ ID NO: 1199 - RNA, 2136 nt, Artificial Sequence
  KX369547.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccgggcuggcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaag

SEQ ID NO: 1200 - RNA, 2136 nt, Artificial Sequence
  KX447515.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacugguaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1201 - RNA, 2136 nt, Artificial Sequence
  KU501217.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgagauccgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaag

SEQ ID NO: 1202 - RNA, 2136 nt, Artificial Sequence
  KU312314.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugcuggcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaag

SEQ ID NO: 1203 - RNA, 2136 nt, Artificial Sequence
  KX446950.2 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgacccuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgcccuucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccgacguggggugcuccguggacuucagcaag

SEQ ID NO: 1204 - RNA, 2136 nt, Artificial Sequence
  KY003157.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccguggugagcgccgacguggggugcuccgucgacuucagcaag

SEQ ID NO: 1205 - RNA, 2136 nt, Artificial Sequence
  KX811222.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcgccugggugguguacgggaccugccaccacaagaagggcgaggcccggcgcucccggcgcgcggucacgcuccccagccacuccacccggaagcugcagacccgcccccagaccuggcuggagagccgggaguacacgaagcaccucauccgcguggagaacuggaucuuccggaacccgggguucgcccuggccgccgccgcgaucgccuggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggcggaggugcgcagcuacugcuacgaggccuccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgcgugcagcaagaagaugacgggcaaguccauccagccggagaaccuggaguaccgcaucaugcugagcguccacggcucccagcacagcgggaugaucgugaacgacaccggccacgagaccgacgagaaccgcgccaaggucgagaucacccccaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccgcugcccuggcacgccggggcggacaccggcacgccccacuggaacaacaaggaggcccugguggaguucaaggacgcccacgccaagcggcagaccgucguggugcucgggagccaggagggcgcgguccacaccgcccuggccggggcccuggaggccgagauggacggcgcgaagggccgccucuccagcgggcaccugaagugccggcugaagauggacaagcuccgccugaagggcguguccuacagccugugcaccgccgccuucacguucaccaagauccccgccgagacccuccacgggaccgugaccgucgaggugcaguacgccggcacggacggcccgugcaaggugcccgcgcagauggccgucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgcgaagcgcauggccguccugggggacaccgccugggacuucggcagcgucgggggcgcccucaacagccuggggaagggcauccaccagaucuucggcgcggccuucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaag

SEQ ID NO: 1206 - RNA, 2136 nt, Artificial Sequence
  KX447516.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagcaagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1207 - RNA, 2136 nt, Artificial Sequence
  KX520666.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccacccgccagaaggugaucuaccuggucaugauccugcucaucgccccggccuacagcauccggugcaucgggguguccaaccgcgacuucguggagggcaugagcggcgggaccugggucgacguggugcuggagcacggcgggugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgggcgaaggucgagaucacgccgaacagcccccgcgccgaggccacccucgggggcuucgggucccugggccuggacugcgagccccggaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggagccaggagggcgccguccacaccgcgcuggccggggcccuggaggccgagauggacggcgccaagggccggcucuccagcgggcaccugaagugccgccugaagauggacaagcuccggcugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgaguccaccgagaacagcaagaugaugcucgagcuggacccgcccuucggcgacuccuacaucgucaucggggugggcgagaagaagaucacccaccacuggcaccggagcggguccacgaucggcaaggccuucgaggccaccgugcgcggcgccaagcggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaag

SEQ ID NO: 1208 - RNA, 2136 nt, Artificial Sequence
  KU729218.1 prME-long CDS GC
cgcaucaucaacgcccggaaggagaagaagcgccggagcgccgacaccuccgugggcaucgucgggcugcuccugaccacggcgauggccgccgaggugacccgccggggcagcgccuacuacauguaccuggaccgcaacgacgccggggaggcgaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucauccgcguggagaacuggaucuuccggaaccccggcuucgcgcuggccgccgccgccaucgcguggcugcucggguccagcaccucccagaaggugaucuaccuggucaugauccugcucaucgccccggccuacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggcguccaucagcgacauggccagcgacucccggugccccacccagggggaggccuaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgcgcgaaggucgagaucacgccgaacagcccccgggccgaggccacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcggcagaccgucguggugcucggcagccaggagggggccguccacaccgcgcuggccggcgcccuggaggccgagauggacggggccaagggccgccucuccagcggccaccugaagugccggcugaagauggacaagcuccgccugaaggggguguccuacagccugugcaccgcggccuucaccuucaccaagauccccgccgagacccuccacggcaccgugacggucgaggugcaguacgccgggaccgacggccccugcaaggugccggcccagauggcggucgacacccagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcagcaccaucgggaaggccuucgaggccaccgugcggggcgccaagcgcauggcgguccugggcgacaccgccugggacuucggguccgugggcggggcccucaacagccugggcaaggggauccaccagaucuucggcgccgcguucaagucccuguucggcgggaugagcugguucucccagauccugaucggcacgcuccugauguggcuggggcucaacaccaagaacggcagcaucucccugaugugccuggcccucgggggcgugcugaucuuccugagcaccgccgucuccgccgacgugggcugcagcguggacuucuccaag

SEQ ID NO: 1209 - RNA, 2136 nt, Artificial Sequence
  KU761561.1 prME-long CDS GC
cgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgcccgccggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaag

SEQ ID NO: 1210 - RNA, 2136 nt, Artificial Sequence
  KY317938.1 prME-long CDS GC
cgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1211 - RNA, 2136 nt, Artificial Sequence
  KY075939.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacucccugcgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaag

SEQ ID NO: 1212 - RNA, 2136 nt, Artificial Sequence
  KX806557.2 prME-long CDS GC
cgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggauguuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaag

SEQ ID NO: 1213 - RNA, 2136 nt, Artificial Sequence
  KU870645.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggauccugcggaaccccggguucgcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucgggaucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaag

SEQ ID NO: 1214 - RNA, 2136 nt, Artificial Sequence
  KU729217.2 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucagcaccaccguguccaacauggccgaggugcgcagcuacugcuacgaggcgacgaucuccgacaucgccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgccgucgugcucgggucccaggagggcgcggugcacaccgcccuggccggggcccuggaggccgagauggacggcgcgaagggccgccucagcuccgggcaccugaagugccggcugaagauggacaagcuccgccugaagggcgucagcuacucccugugcaccgccgccuucaccuucaccaagauccccgccgagacccuccacgggaccgugacgguggagguccaguacgccggcaccgacggccccugcaaggugccggcgcagauggccguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgcgaagcgcauggccgugcugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaag

SEQ ID NO: 1215 - RNA, 2136 nt, Artificial Sequence
  KU497555.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggacccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgaguccaccgagaacagcaagaugaugcucgagcuggacccgcccuucggcgacuccuacaucgucaucggggugggcgagaagaagaucacgcaccacuggcaccgcagcggguccaccaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacgcuccugauguggcugggccucaacaccaagaacgggagcaucucccugaugugccuggcccucggcggcgugcugaucuuccugagcaccgccguguccgccgacguggggugcagcguggacuucuccaag

SEQ ID NO: 1216 - RNA, 2136 nt, Artificial Sequence
  KX087101.3 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgagcugcaguacgccggcaccgacggccccugcaaggugccggcccagauggcgguggacaugcagacccugacccccgucgggcggcucaucacggccaaccccgugaucaccgagagcaccgagaacuccaagaugaugcuggagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaag

SEQ ID NO: 1217 - RNA, 2136 nt, Artificial Sequence
  KY075932.1 prME-long CDS GC
cgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcaucgagaacuggaucuuccggaaccccggguucgcgcuggccgccgccgccaucgcguggcugcucggcagcuccaccagccagaaggugaucuaccuggugaugauccugcucaucgccccggccuacuccauccgcugcaucggggucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaag

SEQ ID NO: 1218 - RNA, 2136 nt, Artificial Sequence
  KY014317.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaucgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaag

SEQ ID NO: 1219 - RNA, 2136 nt, Artificial Sequence
  KU758876.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgugaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagcuucaugugccuggcgcugggcggcgugcucaucuuccuguccaccgccgugagcgccgacguggggugcuccgucgacuucagcaag

SEQ ID NO: 1220 - RNA, 2136 nt, Artificial Sequence
  KU758874.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggcaagcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1221 - RNA, 2136 nt, Artificial Sequence
  KY014314.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggaggcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1222 - RNA, 2136 nt, Artificial Sequence
  KU926310.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcgccgacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaag

SEQ ID NO: 1223 - RNA, 2136 nt, Artificial Sequence
  KU761560.1 prME-long CDS GC
cgcaucaucaacgccggcaaggagaagaagcggcgcggggccgacaccaacgugggcaucgucgggcugcuccugaccacggcgauggccgccgaggugacccggcgcggcagcgccuacuacauguaccuggaccggaacgacgccggggaggcgaucuccuuccccaccacccucggcaugaacaagugcuacauccagaucauggaccugggccacaugugcgacgccacgaugagcuacgagugcccgaugcuggacgaggggguggagcccgacgacgucgacugcuggugcaacaccaccuccaccugggugguguacggcacgugccaccacaagaagggggaggcccgccggagccgccgggccgucacccuccccucccacagcacccgcaagcugcagacccggucccagacguggcuggagagccgcgaguacaccaagcaccucauccggguggagaacuggaucuuccgcaaccccggcuucgcgcuggccgccgccgccaucgcguggcugcucggguccagcaccucccagaaggugaucuaccuggucaugauccugcucaucgccccggccuacagcauccggugcaucggcguguccaaccgcgacuucguggagggcaugagcgggggcaccugggucgacguggugcuggagcacgggggcugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggguggggcaacgggugcggccuguucgggaagggcucccucgugacgugcgccaaguucgccugcagcaagaagaugaccggcaaguccauccagcccgagaaccuggaguaccggaucaugcugagcguccacgggucccagcacagcggcaugaucgugaacgacaccgggcacgagaccgacgagaaccgcgcgaaggucgagaucacgccgaacagcccccgcgccgaggccacccucggcggguucggcucccugggccuggacugcgagccccggaccgggcucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcgccagaccgucguggugcucggcagccaggagggggccguccacaccgcgcuggccggcgcccuggaggccgagauggacggcgccaaggggcggcucuccagcggccaccugaagugccgccugaagauggacaagcuccggcugaaggggguguccuacagccugugcaccgcggccuucaccuucaccaagauccccgccgagacccuccacggcaccgugacggucgaggugcaguacgccggcaccgacgggcccugcaaggugccggcccagauggcggucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucggcaaggccuucgaggccaccgugcgcggggcccggcgcauggcgguccugggcgacaccgccugggacuucgggagcgugggcggggcccucaacagccugggcaagggcauccaccagaucuucggggccgcguucaagucccuguucggcgggaugagcugguucucccagauccugaucggcacccuccugauguggcuggggcucaacacgaagaacggcagcaucucccugaugugccuggcccucggcggggugcugaucuuccugagcaccgccgucuccgccgacgugggcugcagcguggacuucuccaag

SEQ ID NO: 1224 - RNA, 2136 nt, Artificial Sequence
  KY317939.1 prME-long CDS GC
cgcaucaucaacgcccggaaggagaagaagcgccggggcgccgagaccagcguggggaucgucggccugcuccugaccacggcgauggccgccgaggugacccgccggggguccgccuacuacauguaccuggaccgcaaggacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1225 - RNA, 2136 nt, Artificial Sequence
  KY075937.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggucagcgacagccggugccccacccagggcgaggccuaccucgacaagcaguccgacacccaguacgugugcaagcgcacccugguggaccggggcugggggaacggcugcgggcuguucggcaaggggagccucgucacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggucccaggagggcgccgugcacaccgcccuggcgggggcccuggaggccgagauggacggcgccaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacguggggugcuccgucgacuucagcaag

SEQ ID NO: 1226 - RNA, 2136 nt, Artificial Sequence
  LC191864.1 prME-long CDS GC
cgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaugaccuccaccugggugguguacgggaccugccaccacaagaagggcgaggcccggcgcagccggcgcgccgucacgcuccccucccacagcacccggaagcugcagacccgcucccagaccuggcuggagagccgggaguacacgaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggccgaggugcgcagcuacugcuacgaggcguccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgccugcagcaagaagaugacgggcaaguccauccagcccgagaaccuggaguaccgcaucaugcugagcguccacggcucccagcacagcgggaugaucgugaacgacaccggccacgagaccgacgagaaccgcgcgaaggucgagaucaccccgaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucacguucaccaagauccccgccgagacccuccacgggaccgugaccgucgaggugcaguacgccggcacggacggccccugcaaggugccggcccagauggcggucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaag

SEQ ID NO: 1227 - RNA, 2136 nt, Artificial Sequence
  KX447517.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccgcccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagacccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1228 - RNA, 2136 nt, Artificial Sequence
  KU922923.1 prME-long CDS GC
cgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgcccuggccuacuccauccgcugcaucggggugagcaaccgggacuucguggagggcauguccggcgggaccugggucgacguggugcuggagcacggcgggugcgucacggugauggcccaggacaagccgaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgcccaacagcccgcgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugcccuggcacgccggggccgacacgggcaccccgcacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcacggcggccuucaccuucaccaagauccccgccgagacccugcacgggaccgugacggucgaggugcaguacgccggcaccgacggccccugcaaggugcccgcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaag

SEQ ID NO: 1229 - RNA, 2136 nt, Artificial Sequence
  KY003156.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucgggaucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggauccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggagccaggagggcgccgugcacaccgcgcuggccggggcccuggaggccgagauggacggcgccaagggccgccucuccagcgggcaccugaagugccggcugaagauggacaagcuccgccugaagggcgucuccuacagccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcggguccacgaucggcaaggccuucgaggccaccgugcggggcgccaagcgcauggcggugcugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacgucgggugcagcguggacuucuccaag

SEQ ID NO: 1230 - RNA, 2136 nt, Artificial Sequence
  KU312313.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccauccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacgccaagaacggguccaucagccugaugugccuggcccucggcggcgugcugaucuuccuguccacggccgugagcgccgacguggggugcuccguggacuucagcaag

SEQ ID NO: 1231 - RNA, 2136 nt, Artificial Sequence
  KY075935.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccagcggucccgccgggccgucacccuccccagccacuccacccgcaagcugcagacccggagccagacguggcuggagucccgcgaguacaccaagcaccucauccggguggagaacuggaucuuccgcaaccccggguucgcgcuggccgccgccgccaucgcguggcugcucggcagcuccaccagccagaaggugaucuaccuggucaugauccugcucaucgccccggccuacuccauccggugcaucggggugagcaaccgcgacuucguggagggcauguccggcgggaccugggucgacguggugcuggagcacggcgggugcgucacggugauggcccaggacaagcccaccguggacaucgagcuggucaccaccacggugagcaacauggccgaggugcgguccuacugcuacgaggcgagcaucuccgacauggccagcgacagccgcugccccacccagggcgaggccuaccucgacaagcaguccgacacccaguacgucugcaagcggacccugguggaccgcggcugggggaacggcugcgggcuguucggcaaggggagccucgugacgugcgccaaguucgccugcuccaagaagaugaccggcaagagcauccagcccgagaaccuggaguaccggaucaugcuguccguccacggcagccagcacuccgggaugaucgugaacgacaccggccacgagaccgacgagaaccgcgcgaaggucgagaucacgccgaacagcccccgcgccgaggccacccucgggggcuucgggucccugggccuggacugcgagccccggaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggucccaggagggcgccguccacaccgcgcuggccggggcccuggaggccgagauggacggcgccaagggccggcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaag

SEQ ID NO: 1232 - RNA, 2136 nt, Artificial Sequence
  KY014320.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcaggcgcgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaag

SEQ ID NO: 1233 - RNA, 2136 nt, Artificial Sequence
  KX827309.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcagcgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccagcgacucccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcgggagcacgaucggcaaggccuucgaggccaccgugcggggcgccaagcgcauggcgguccugggggacaccgccugggacuucggcuccgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaag

SEQ ID NO: 1234 - RNA, 2136 nt, Artificial Sequence
  KU681081.3 prME-long CDS GC
cgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacaccggggccgacaccggcacgccccacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuccagcgggcaccugaagugccggcugaagauggacaagcuccgccugaagggcguguccuacagccugugcaccgccgccuucaccuucaccaagauccccgcggagacgcuccacgggaccgugaccgucgaggugcaguacgccggcaccgacggccccugcaaggugccggcccagauggccgucgacaugcagacgcugacccccguggggcggcugaucaccgccaaccccgugaucaccgagggcacggagaacuccaagaugaugcucgagcuggacccgcccuucggggacagcuacaucgucaucggcgugggggagaagaagaucacccaccacuggcaccgcuccggcagcaccaucggcaaggcguucgaggccaccgugcgcggggccaagcggauggccguccugggcgacacggccugggacuucgggagcgugggcggggugcucaacucccugggcaagggcauccaccagaucuucggggcggccuucaagagccuguucggcgggauguccugguucagccagauccugaucggcacccuccugauguggcuggggcucaacaccaagaacggcuccaucagccugaugugccuggcccucggcgggguccugaucuuccuguccaccgccgugagcgcggacgugggcugcuccgucgacuucagcaag

SEQ ID NO: 1235 - RNA, 2136 nt, Artificial Sequence
  KU744693.1 prME-long CDS GC
cgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggccauggcccaggacaagcccaccguggacaucgagcuggugaccaccacggucagcaacauggcggaggugcgcuccuacugcuacgaggccagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgcgugcuccaagaagaugaccggcaagagcauccagcccgagaaccuggaguaccgcaucaugcuguccgugcacggcagccagcacuccgggaugcucgucaacgacaccggccacgagaccgacgagaaccgcgccaagguggagaucacgccgaacagcccccgggccgaggccacccucgggggcuucgggucccugggccuggacugcgagccccgcaccggccuggacuucagcgaccuguacuaccucaccaugaacaacaagcacuggcuggcccacaaggagugguuccacgacaucccccugccguggcacgcgggggccgccacgggcacgccccacuggaacaacaaggaggcccucgucgaguucaaggacgcgcacgccaagcggcagaccguggugguccuggggucccaggagggcgccgugcacaccgcccuggccggggcgcucgaggccgagauggacggcgccaagggccgccugagcuccgggcaccugaagugccggcucaagauggacaagcugcgccugaagggcgugagcuacucccucugcaccgccgccuucaccuucaccaagauccccgcggagaccgucgacgggaccgugacgguggagggccaguacggcgggaccgacggccccugcaaggucccggcccagauggccguggacaugcagacccugacccccguggggcggcugaucacggccaaccccgucaucaccgagagcaccgagaacuccaagaugaugcucgagcuggacccgcccuucggcgacagcuacaucgugaucggggugggcgagaagaagaucacccaccacuggcaccgcuccggcagcacgaucgggaaggccuucgaggcgaccguccggggcgccaagcgcauggccgugcugggggacaccgccugggacuucggcagcgucgggggcgcgcucaacucccugggcaaggggauccaccagaucaucggcgccgccuucaagagccuguucgggggcauguccugguucagccagauccugaucgggacccuccugauguggcugggccucaacacgaagaacggcuccaucagccugaugugccuggcccucgggggcgugcugaucuuccuguccaccgccgugagcgggggcguggggugcuccgucgacuucagcaag

SEQ ID NO: 1236 - RNA, 2136 nt, Artificial Sequence
  KY328290.1 prME-long CDS GC
cgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucuccaagauccccgccgagacccuccacgggaccgugacggaggagguccaguacgccggcaccgacggccccugcaaggugccggcccagauggccguggacaugcagacccugacccccgucgggcggcugaucacggcgaaccccgugaucaccgagagcaccgagaacuccaagaugaugcucgagcuggacccgcccuucggcgacagcuacaucgugaucggggucggcgagaagaagaucacccaccacuggcaccgcagcggguccacgaucggcaaggccuucgaggccaccgugcggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacgucgggugcuccguggacuucagcaag

SEQ ID NO: 1237 - RNA, 2136 nt, Artificial Sequence
  KX694532.2 prME-long CDS GC
cgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccugaugugccuggcgcucggcggcgugcugaucuuccugagcaccgccguguccgccgacguggggugcagcguggacuucuccaag

SEQ ID NO: 1238 - RNA, 2136 nt, Artificial Sequence
  KU955593.1 prME-long CDS GC
cgcaucaucaacgcccggaaggagaagaagcgccggggcaccgacaccagcguggggaucgucggccugcuccugacgaccgccauggcgguggaggugacccgccgggggaacgccuacuacauguaccuggaccgcuccgacgccggcgaggccaucagcuuccccaccacgauggggaugaacaagugcuacauccagaucauggaccucggccacaugugcgacgccaccauguccuacgagugcccgaugcuggacgagggcgucgagcccgacgacguggacugcuggugcaacaccaccagcacguggguggucuacgggaccugccaccacaagaagggcgaggcgcggcgcucccggcgcgccgugacccugcccagccacuccacccggaagcuccagacgcgcagccagaccuggcuggagucccgggaguacaccaagcaccugauccgcguggagaacuggaucuuccggaaccccggguucgcccucgccgcggccgccaucgccuggcugcugggcagcuccaccagccagaaggucaucuaccucgugaugauccugcugaucgccccggcguacuccauccgcugcaucggggugagcaaccgggacuucgucgagggcauguccggcgggacguggguggacgugguccucgagcacggcgggugcgugaccgugauggcccaggacaagcccaccgucgacaucgagcuggugaccacgaccgugagcaacauggccgagguccgcuccuacugcuacgaggccagcaucuccgacauggccagcgacagccggugccccacccagggcgaggcguaccuggacaagcaguccgacacccaguacgugugcaagcgcacgcucguggaccggggcugggggaacggcugcgggcuguucggcaaggggagccuggugaccugcgccaaguucgccugcuccaagaagaugaccggcaagagcauccagcccgagaaccucgaguaccgcaucaugcuguccgugcacggcagccagcacuccgggaugaucgucaacgacaccggccacgagacggacgagaaccgcgccaagguggagaucaccccgaacagcccccgggccgaggcgacccucgggggcuucgggucccugggccuggacugcgagccccgcaccggccuggacuucagcgaccucuacuaccugacgaugaacaacaagcacuggcuggugcacaaggagugguuccacgacaucccccucccguggcacgccggggccgacaccggcacgccccacuggaacaacaaggaggcccuggucgaguucaaggacgcccacgcgaagcggcagaccguggugguccuggggucccaggagggcgccgugcacaccgcccucgccggggcgcuggaggccgagauggacggcgccaagggccgccugagcuccgggcaccucaagugccggcugaagauggacaagcugcgccucaagggcgugagcuacucccugugcaccgccgccuucaccuucaccaagauccccgcggagacccugcacgggacggucaccguggaggugcaguacgccggcaccgacggccccugcaaggucccggcccagauggccguggacaugcagacccucacgcccguggggcggcugaucaccgccaaccccgucaucaccgagagcaccgagaacuccaagaugaugcuggagcucgacccgcccuucggcgacagcuacaucgugaucggggugggcgagaagaagaucacgcaccacuggcaccgcuccgggagcaccaucggcaaggcguucgaggccaccguccggggcgccaagcgcauggccgugcugggggacaccgccugggacuucggcagcgucgggggcgcgcugaacucccucgggaagggcauccaccagaucuucggcgccgccuucaagagccuguucgggggcauguccugguucagccagauccugaucgggacgcugcucgucuggcugggccugaacaccaagaacggguccaucagccucaugugccuggcccugggcggcgugcucaucuuccuguccaccgcggugagcgccgacgucgggugcuccguggacuucagcaag

SEQ ID NO: 1239 - RNA, 2136 nt, Artificial Sequence
  KY272987.1 prME-long CDS GC
cgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccuggugugccuggcgcucggcggcgugcugaucuuccugagcaccgccguguccgccgacguggggugcagcgucgacuucuccaag

SEQ ID NO: 1240 - RNA, 2136 nt, Artificial Sequence
  EU545988.1 prME-long CDS GC
cgcaucaucaacgcccggaaggagaagaagcgccggggcaccgacaccagcguggggaucgucggccugcuccugacgaccgccauggcgguggaggugacccgccggggguccgccuacuacauguaccuggaccgcagcgacgccggcgaggccaucuccuuccccaccacgcucgggaugaacaagugcuacauccagaucauggaccugggccacaugugcgacgccaccaugagcuacgagugcccgaugcuggacgagggcgucgagcccgacgacguggacugcuggugcaacaccaccuccacguggguggucuacgggaccugccaccacaagaagggcgaggcgcggcgcagccggcgcgccgugacccuccccucccacagcacccggaagcugcagacgcgcucccagaccuggcuggagagccgggaguacaccaagcaccucauccgcguggagaacuggaucuuccggaaccccggguucgcccuggccgcggccgccaucgccuggcugcucggcuccagcaccucccagaaggucaucuaccuggugaugauccugcucaucgccccggcguacagcauccgcugcaucgggguguccaaccgggacuucgucgagggcaugagcggcgggacguggguggacgugguccuggagcacggcgggugcgugaccgugauggcccaggacaagcccgccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucgccugcagcaagaagaugaccggcaaguccauccagcccgagaaccuggaguaccgcaucaugcugagcgugcacggcucccagcacagcgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgaguccaccgagaacagcaagaugaugcucgagcuggacccgcccuucggcgacuccuacaucgugaucggggugggcgagaagaagaucacccaccacuggcaccgcagcgggagcacgaucggcaaggccuucgaggccaccguccggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccguguccgccgacgucgggugcagcguggacuucuccaag

SEQ ID NO: 1241 - RNA, 2136 nt, Artificial Sequence
  KU681082.3 prME-long CDS GC
cgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucgggaugaacaagugcuacauccagaucauggaccugggccacaugugcgacgcgacgaugagcuacgagugcccgaugcuggacgagggcgucgagcccgacgacguggacugcuggugcaacaccaccuccaccuggguggucuacgggacgugccaccacaagaagggcgaggcccggcgcagccggcgcgccgugacccuccccucccacagcacccggaagcugcagacccgcucccagacguggcuggagagccgggaguacaccaagcaccucauccgcguggagaacuggaucuuccggaaccccggguucgcccuggcggccgccgucaucgccuggcugcucggcuccagcaccucccagaaggugaucuaccuggugaugauccugcucaucgccccggcguacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggccagcgacucccggugccccacccagggcgaggcguaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggccgaggcgacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuccagcgggcaccugaagugccggcugaagauggacaagcuccgccugaagggcgucuccuacagccugugcaccgccgccuucaccuucaccaagauccccgcggagacccuccacgggaccgugacgguggagguccaguacgccggcaccgacggccccugcaaggugccggcccagauggccguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcgggagcacgaucggcaaggcguucgaggccaccgugcggggcgccaagcgcauggccgugcugggggacaccgccugggacuucggcuccgucgggggcgcgcucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcccucggcggcgugcugaucuuccugagcaccgcggucuccgccgacguggggugcagcguggacuucuccaag

SEQ ID NO: 1242 - RNA, 2136 nt, Artificial Sequence
  KX601167.1 prME-long CDS GC
cgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucaccuucaccaagauccccgccgagacccuccacgggaccgugacgguggagguccaguacgccggcaccgacggccccugcaaggugccggcccagauggccguggacaugcagacccugacccccgucgggcggcugaucacggcgaaccccgugaucaccgaguccaccgagaacagcaagaugaugcucgagcuggacccgcccuucggcgacuccuacaucgugaucggggucggcgacaagaagaucacccaccacugguaccgcagcgggagcacgaucggcaaggccuucgaggccaccgugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccgucuccgccgacguggggugcagcguggacuucuccaag

SEQ ID NO: 1243 - RNA, 2136 nt, Artificial Sequence
  KX694533.2 prME-long CDS GC
cgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcaaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggagaucaccccgaacagcccccgggcggaggccacgcucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacaccggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucacguucaccaagauccccgccgagacccuccacgggaccgugaccguggagguccaguacgccggcacggacggccccugcaaggugccggcccagauggccguggacaugcagacccugacccccgucgggcggcugaucaccgcgaaccccgugaucacggaguccaccgagaacagcaagaugaugcucgagcuggacccgcccuucggcgacuccuacaucgugaucggggucggcgacaagaagaucacccaccacuggcaccgcagcgggagcaccaucggcaaggccuucgaggccacggugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacaccaagaacgggagcaucucccugacgugccuggcgcucggcggcgugcugaucuuccugagcaccgccgucuccgccgacguggggugcagcguggacuucuccaag

SEQ ID NO: 1244 - RNA, 2136 nt, Artificial Sequence
  KY288905.1 prME-long CDS GC
cgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggccacccucgggggcuucgggagccugggccuggacugcgagccccgcacgggccucgacuucuccgaccuguacuaccugaccaugaacaacaagcacuggcucgugcacaaggagugguuccacgacaucccccugcccuggcacgcgggggccgacaccggcaccccgcacuggaacaacaaggaggcccugguggaguucaaggacgcccacgccaagcggcagacggucguggugcucgggagccaggagggcgcgguccacaccgcccuggccggggcccuggaggcggagauggacggcgccaagggccgccucuucuccgggcaccugaagugccggcugaagauggacaagcuccgccugaagggcgugagcuacucccugugcaccgccgccuucaccuucaccaaggugcccgccgagacgcuccacgggaccgucaccguggaggugcaguacgcgggcaccgacggccccugcaagguccccgcccagauggccguggacaugcagacgcugaccccgguggggcggcugaucaccgccaaccccgucaucaccgagagcacggagaacuccaagaugaugcucgagcuggacccgcccuucggcgacagcuacaucgugaucggggugggcgacaagaagaucacccaccacuggcaccgcuccgggagcaccaucggcaaggccuucgaggcgaccguccggggcgccaagcgcauggccgugcugggggacacggccugggacuucggcagcgucgggggcguguucaacucccucgggaagggcauccaccagaucuucggcgccgcguucaagagccuguucgggggcauguccugguucagccagauccugaucgggacccugcucguguggcugggccugaacaccaagaacggguccaucagccugaccugccucgcccugggcggcgugaugaucuuccucuccacggccgucagcgccgacguggggugcuccguggacuucagcaag

SEQ ID NO: 1245 - RNA, 2136 nt, Artificial Sequence
  KF268950.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaaggucgaggugacccccaacuccccgcgggcggaggccacgcucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacaccggcacgccgcacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuucuccgggcaccugaagugccggcugaagauggacaagcuccgccugaagggcgugagcuacucccugugcaccgccgcguucacguucaccaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcgugcaccagaucuucggcgccgccuucaagagccuguucgggggcauguccugguucagccagauccugaucgggacccugcucgucuggcugggccugaacaccaagaacggguccaucagccucacgugccuggcccugggcggcgugaugaucuuccucuccaccgcggugagcgccgacgucgggugcuccguggacuucagcaag

SEQ ID NO: 1246 - RNA, 2136 nt, Artificial Sequence
  KF383121.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaucggccacgagaccgacgagaaccgcgccaagguggaggugacccccaacuccccgcgggccgaggcgacccucgggggcuucgggagccugggccuggacugcgagccccgcaccggccucgacuucuccgaccuguacuaccugaccaugaacaacaagcacuggcucguccacaaggagugguuccacgacaucccccugcccuggcacgccggggccgacacgggcaccccgcacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuucuccgggcaccugaagugccggcugaagauggacaagcuccgccugaagggcgucagcuacucccugugcacggccgccuucaccuucaccaaggugcccgcggagacccuccacgggaccgugacggucgaggugcaguacgccggcaccgacggccccugcaaggugcccgcccagauggccgucgacaugcagacccugaccccgguggggcggcugaucacggccaaccccgugaucaccgagagcaccgagaacuccaagaugaugcucgagcuggacccgcccuucggcgacagcuacaucgucaucggggugggcgacaagaagaucacccaccacuggcaccgcuccgggagcacgaucggcaaggcguucgaggccaccgugcggggcgccaagcgcauggccguccugggggacaccgccugggacuucggcagcgucgggggcguguucaacucccucgggaagggcauccaccagaucuucggcgcggccuucaagagccuguucgggggcauguccugguucagccagauccugaucgggacccugcucguguggcugggccugaacacgaagaacggguccaucagccugaccugccucgcccugggcggcgugaugaucuuccucuccaccgccgugagcgcggacgucgggugcuccguggacuucagcaag

SEQ ID NO: 1247 - RNA, 2118 nt, Artificial Sequence
  KF268949.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaaggucgaggugacccccaacuccccgcgggcggaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcccuggucgaguucaaggacgcgcacgccaagcggcagacgguggugguccucggcagccaggagggggccgugcacaccgcccuggcgggcgcccuggaggccgagauggacggggccaagggccgccucuucuccggccaccugaagugccggcugaagauggacaagcuccgccugaagggggugagcuacucccugugcaccgccgcguucaccuucacgaagguccccgccgagacccuccacggcaccgugaccguggagguccaguacgccgggaccgacggccccugcaaggugcccgcccagauggccguggacaugcagacgcugaccccggucggccggcugaucaccgcgaaccccgugaucaccgagagcacggagaacuccaagaugaugcucgagcuggacccgcccuucggggacagcuacaucgugaucggcgucggggacaagaagaucacccaccacuggcaccgcuccggcagcaccaucgggaaggccuucgaggccaccgugcggggcgccaagcgcauggccgugcugggcgacacggcgugggacuucgggagcgucggcgggguguucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgucaugaucuuccucuccacggcggugagcgccgacgugggcugcuccgucgacuucagcaag

SEQ ID NO: 1248 - RNA, 2136 nt, Artificial Sequence
  KU955595.1 prME-long CDS GC
cgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugacgaugaacaacaagcacuggcucgugcacaaggagugguuccacgacaucccccugcccuggcacgccggggccgacaccggcaccccgcacuggaacaacaaggaggcccugguggaguucaaggacgcccacgcgaagcggcagaccgucguggugcucgggagccaggagggcgccguccacacggcccuggccggggcgcuggaggccgagauggacggcgccaagggccgccucuucuccgggcaccugaagugccggcugaagauggacaagcuccgccugaagggcgugagcuacucccugugcaccgccgccuucaccuucaccaaggugcccgcggagacccuccacgggacggucaccguggaggugcaguacgccggcaccgacggccccugcaagguccccgcccagauggccguggacaugcagacccugacgccgguggggcggcugaucaccgccaaccccgucaucaccgagagcaccgagaacuccaagaugaugcucgagcuggacccgcccuucggcgacagcuacaucgugaucggggugggcgacaagaagaucacgcaccacuggcaccgcuccgggagcaccaucggcaaggcguucgaggccaccguccggggcgccaagcgcauggccgugcugggggacaccgccugggacuucggcagcgucgggggcguguucaacucccucgggaagggcauccaccagaucuucggcgcggccuucaagagccuguucgggggcauguccugguucagccagauccugaucgggacgcugcucguguggcugggccugaacaccaagaacggguccaucagccugaccugccucgcccugggcggcgugaugaucuuccucuccaccgccgucagcgcggacguggggugcuccguggacuucagcaag

SEQ ID NO: 1249 - RNA, 2136 nt, Artificial Sequence
  KF383116.1 prME-long CDS GC
cgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccagcacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuucuccgggcaccugaagugccggcugaagauggacaagcuccgccugaagggcgugagcuacucccugugcacggccgugugcaccgccgcgaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcauccaccagaucuucggcgccgccuucaagagccuguucgggggcauguccugguucagccagauccugaucgggacccugcucguguggcugggccugaacaccaagaacggguccaucagccucacgugccuggcccugggcggcgucaugaucuuccucuccaccgcggugagcgccgacguggggugcuccgucgacuucagcaag

SEQ ID NO: 1250 - RNA, 2118 nt, Artificial Sequence
  KU963574.2 prME-long CDS GC
cgcaucaucaacgcccggaaggagcgcaagcggcgcggcgccgacgcgagcaucgggaucgugucccugcuccugaccaccgucauggccgccgagaucacgcggcgcggcagcgccuacuacauguaccuggaccgguccgacgccgggaaggcgaucagcuucgugaccacccucggcgugaacaagugccacguccagaucauggaccuggggcacaugugcgacgccaccauguccuacgagugccccaugcuggacgagggcguggagcccgacgacguggacugcuggugcaacacgaccagcaccugggucguguacgggaccugccaccacaagaagggggaggcccgccggucccgccgggccgugacgcuccccagccacuccacccgcaagcugcagacccggagccagaccuggcuggagucccgcgaguacacgaagcaccucaucaaggucgagaacuggaucuuccggaaccccggcuucgcgcugguggccguggccaucgccuggcugcucgggagcuccaccagccagaaggucaucuaccuggugaugauccugcucaucgcccccgcguacuccauccgcugcaucggcgugagcaaccgggacuucgucgaggggauguccggcggcaccuggguggacgugguccuggagcacgggggcugcgugaccgugauggcccaggacaagccgacggucgacaucgagcuggugaccaccaccgugagcaacauggccgagguccgcuccuacugcuacgaggccagcaucagcgacauggccuccgacagccggugccccacgcagggggaggcguaccucgacaagcaguccgacacccaguacgugugcaagcgcacccuggucgaccggggcuggggcaacgggugcggccuguucgggaagggcagccucgugaccugcgccaaguucacgugcuccaagaagaugaccggcaagagcauccagcccgagaaccuggaguaccgcaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgcggacaccgagaccccgcacuggaacaacaaggaggcccugguggaguucaaggacgcccacgccaagcggcagacgguggucgugcucggcagccaggagggggccgugcacaccgcgcuggccggcgcccuggaggccgagauggacggggcgaagggccgccucuccagcgggcaccugaagugccggcugaagauggacaagcuccgccugaagggcgucuccuacagccugugcaccgccgccuucaccuucacgaaggugcccgccgagacccuccacggcaccgugaccgucgaggugcaguacgccgggcgggacggccccugcaaggugcccgcgcagauggccgucgacaugcagacccugacgccgguggggcgccugaucaccgccaaccccgugaucaccgaguccaccgagaacagcaagaugaugcucgagcuggacccgcccuucggcgacagcuacaucgucaucggcgugggggacaagaagaucacgcaccacuggcaccgguccggcagcaucaucgggaaggccuucgaggccaccgugcgcggcgcgaagcggauggccguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcgcucgggggcgugaugaucuuccucagcaccgccguguccgccgacgucgggugcagcguggacuucuccaag

SEQ ID NO: 1251 - RNA, 2118 nt, Artificial Sequence
  KX601166.1 prME-long CDS GC
cgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggcgacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgccgacaccgggacgccgcacuggaacaacaaggaggcccugguggaguucaaggacgcccacgcgaagcggcagaccgucguggugcucggcagccaggagggggccguccacaccgcccuggccggcgcgcuggaggccgagauggacggggccaagggccgccucuucuccggccaccugaagugccggcugaagauggacaagcuccgccugaagggggugagcuacucccugugcaccgccgccuucacguucaccaaggugcccgcggagacccuccacggcaccgucaccguggaggugcaguacgccgggacggacggccccugcaagguccccgcccagauggccguggacaugcagacccugaccccggugggccggcugaucaccgccaaccccgucaucacggagagcaccgagaacuccaagaugaugcucgagcuggacccgcccuucggggacagcuacaucgugaucggcgugggggacaagaagaucacccaccacuggcaccgcuccggcagcaccaucgggaaggcguucgaggccacgguccggggcgccaagcgcauggccgugcugggcgacaccgccugggacuucgggagcgugggcggggucuucaacucccucggcaaggggauccaccagaucuucggcgcggccuucaagagccuguucggcgggauguccugguucagccagauccugaucggcacccugcucguguggcuggggcugaacaccaagaacggcuccaucagccucacgugccuggcccucgggggcgugaugaucuuccuguccaccgccgucagcgcggacgugggcugcuccguggacuucagcaag

SEQ ID NO: 1252 - RNA, 2136 nt, Artificial Sequence
  KF383118.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgagacccgccggagccgccgguccgugagccuccgcuaccacuacacccggaagcugcagacccgcucccagacguggcuggagagccgggaguacaagaagcaccucaucauggucgagaacuggaucuuccgcaaccccggguucgccaucguguccguggcgaucaccuggcugaugggcagccugaccucccagaaggucaucuaccucgugaugaucgugcugaucguccccgccuacagcaucuccugcaucggggugagcaaccgggaccugguggagggcauguccggcgggaccugggucgacguggugcucgagcacggcgggugcgucacggagauggcccaggacaagcccaccguggacaucgagcuggugaccaugaccgucagcaacauggccgaggugcgcuccuacugcuacgaggccagccugagcgacauggcguccgccagccggugcccgacgcagggcgagcccucccucgacaagcagagcgacacccaguccgugugcaagcgcacccugggcgaccggggguggggcaacgggugcggcaucuucgggaagggcagccuggugaccugcuccaaguucacgugcugcaagaagaugcccggcaagagcauccagcccgagaaccucgaguaccgcaucaugcugccgguccacgggucccagcacagcggcaugaucgucaacgacaucgggcacgagaccgacgagaaccgcgccaagguggaggugacccccaacagcccccgggccgaggccacccugggcggguucggcucccucggccuggacugcgagccccgcacggggcuggacuucuccgaccucuacuaccugaccaugaacaacaagcacuggcugguccacaaggagugguuccacgacaucccgcuccccuggcacgcgggcgccgacaccgggacgccccacuggaacaacaaggaggcccugguggaguucaaggacgcccacgccaagcggcagaccguggucgugcugggcagccaggagggggcggugcacaccgcccucgccggcgcccuggaggccgagauggacggcgcgaaggggcgccuguucuccggccaccucaagugccggcugaagauggacaagcugcgccucaagggggucagcuacucccugugcaccgccgccuucaccuucacgaaggugcccgccgagacccugcacggcaccgugaccgucgaggugcagagcgcgggcaccgacgggccgugcaaggugcccgcccagauggccgucgacaugcagacgcucacccccgugggccggcugaucaccgccaaccccgugaucaccgaguccacggagaacagcaagaugaugcuggagcucgacccgcccuucggggacagcuacaucgucaucggcgugggggacaagaagaucacccaccacuggcaccgcuccggcagcaccaucggcaaggccuucgaggcgaccgugcgcggggccaagcggauggccguccugggcgacacggccugggacuucggguccgugggcgggguguucaacagccugggcaagggcauccaccagaucuucggggccgcguucaagucccucuucggcgggaugagcugguucucccagauccugaucggcacccugcuggucuggcucgggcugaacaccaagaacggcagcaucucccugaccugccucgcccugggcggggugaugaucuuccugagcacggccguguccgccgacgucggcugcagcguggacuucuccaag

SEQ ID NO: 1253 - RNA, 2130 nt, Artificial Sequence
  KF383120.1 prME-long CDS GC
cgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccgccccagccggcgcgcggugacccugcccucccacagcacccggaagcuccagacccgcucccagacguggcuggagagccgggaguacaccaagcaccugaucaaggucgagaacuggauccuccgcaaccccggguucaccguggccgcccuggccauggccuggcugcucggcaacuccaccagccagcgggugaucuaccuggucaugauccugcucaucgcgccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggccagcaucuccgacauggcgagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucacgugcuccaagaagaugaccggcaagagcauccagcccgagaaccuggaguaccgcaucaugcuguccguccacggcagccagcacuccgggaugaucgugaacgacaucggccacgagaccgacgagaaccgcgccaaggucgaggugaccccgaacagcccccgggccgaggcgacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcccuggucgaguucaaggacgcccacgcgaagcggcagaccguggugguccucgggucccaggagggcgccgugcacaccgcccuggccggggcgcuggaggccgagauggacggcgccaagggccgccucuucagcgggcaccugaagugccggaucaagauggacaagcugcgccucaagggcguguccuacagccugugcaccgccgccuucaccuucuccaagguccccgcggagacccugcacgggaccgugacgguggagguccaguacgccggccgggacggccccugcaaggugccggcccagauggccguggacaugcagacccucacccccgucgggcgccugaucaccgccaaccccaucaucacggagagcaccgagaacucccggaugaugcuggagcucgacccgcccuucggcgacagcuacaucgugaucggggugggcgacaagaagaucacccaccacuggcaccgcuccgggagcaccaucggcaaggcguucgaggccacgguccggggcgccaagcgcauggccgugcugggggacaccgccugggacuucggcagcgucgggggcguguucaacucccuggggaagggcgugcaccagguguucggcgcggccuucaagagccucuucgggggcauguccugguucagccagauccugaucgggacccugcuggucuggcucggccugaacaccaagaacggguccaucagccuggccugccucgcccugggcggcgcgaugaucuuccuguccacggccgugagcgccgacguggggugcuccgucgacuuc

SEQ ID NO: 1254 - RNA, 2061 nt, Artificial Sequence; identical to SEQ ID NO: 1089
  KU321639.1 prME-short CDS GC

SEQ ID NO: 1255 - RNA, 2061 nt, Artificial Sequence; identical to SEQ ID NO: 1090
  KU312312.1 prME-short CDS GC

SEQ ID NO: 1256 - RNA, 2049 nt, Artificial Sequence; identical to SEQ ID NO: 1091
  AY632535.2 prME-short CDS GC

SEQ ID NO: 1257 - RNA, 2061 nt, Artificial Sequence; identical to SEQ ID NO: 1092
  KU527068.1 prME-short CDS GC

SEQ ID NO: 1258 - RNA, 2061 nt, Artificial Sequence
  KX421193.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaccggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgcc

SEQ ID NO: 1259 - RNA, 2061 nt, Artificial Sequence
  KX377335.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccggaagaagggggaggcccgccggagccgccgggccgugacccuccccucccacagcacccgcaagcugcagacccggucccagacguggcuggagagccgcgaguacaccaagcaccucaucaaggucgagaacuggaucuuccggaaccccggcuucgcccugguggcgguggccaucgccuggcugcucggguccagcaccucccagaaggucaucuaccuggugaugauccugcucaucgcccccgccuacagcauccgcugcaucggcguguccaaccgggacuucgucgaggggaugagcggcggcaccuggguggacgugguccuggagcacgggggcugcgugacggugauggcgcaggacaagccgaccgucgacaucgagcuggugaccaccacgguguccaacauggccgagguccgcagcuacugcuacgaggccuccaucagcgacauggccagcgacucccggugccccacccagggggaggccuaccucgacaagcagagcgacacccaguacgugugcaagcgcacccugguggaccggggcuggggcaacgggugcggccuguucgggaagggcucccucgucacgugcgcgaaguucacgugcagcaagaagaugaccgggaaguccauccagcccgagaaccuggaguaccgcaucaugcugagcgugcacggcucccagcacagcggcaugaucgucaacgacaccggguacgagaccgacgagaaccgggccaagguggaggugacccccaacuccccgcgcgccgaggccacccucggcggguucggcagccuggggcuggacugcgagccccggaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcgccagaccguggucgugcucggcagccaggagggggccgugcacacggcgcuggccggcgcccuggaggccgagauggacggggcgaagggcaagcuguucuccggccaccugaagugccgccugaagauggacaagcuccggcugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccgccugaucaccgccaaccccgugaucaccgagagcaccgagaacuccaagaugaugcucgagcuggacccgcccuucggggacagcuacaucgucaucggcgugggggacaagaagaucacgcaccacuggcaccgguccggcagcaccaucgggaaggccuucgaggccaccgugcgcggcgccaagcggauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgcc

SEQ ID NO: 1260 - RNA, 2061 nt, Artificial Sequence
  LC002520.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaccgucaacgacaucggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgcc

SEQ ID NO: 1261 - RNA, 2043 nt, Artificial Sequence
  DQ859059.1 prME-short CDS GC
accagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgcgaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgccgacacgggcaccccgcacuggaacaacaaggaggcgcugguggaguucaaggacgcccacgccaagcggcagaccgucguggugcucgggagccaggagggcgccguccacaccgcccuggcgggggcccuggaggccgagauggacggcgccaaggggcgccucuucuccggccaccugaagugccgccugaagauggacaagcuccggcugaagggcgugagcuacucccugugcacggcggccuucaccuucaccaaggugcccgccgagacccuccacgggaccgucacgguggaggugcaguacgccggcaccgacgggcccugcaagguccccgcccagauggcgguggacaugcagacccugaccccggugggccgccugaucacggccaaccccgucaucaccgagagcaccgagaacuccaagaugaugcucgagcuggacccgcccuucggcgacagcuacaucgugaucggggugggcgacaagaagaucacccaccacuggcaccgguccgggagcacgaucggcaaggccuucgaggccaccguccgcggggccaagcggauggcggugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacacgaagaacggguccaucagccugaccugccucgcccugggcggggugaugaucuuccucuccaccgcggucagcgcc

SEQ ID NO: 1262 - RNA, 2049 nt, Artificial Sequence
  KU963573.2 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucggguacgagaccgacgagaaccgcgccaaggucgaggugacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccuggucgaguucaaggacgcccacgccaagcggcagaccguggugguccucggcagccaggagggggccgugcacaccgcgcuggccggcgcccuggaggccgagauggacggggcgaagggcaagcuguucuccggccaccugaagugccgccugaagauggacaagcuccgccugaagggggugagcuacucccugugcacggccgccuucaccuucaccaagguccccgccgagacccuccacggcaccgugacgguggagguccaguacgccgggaccgacggccccugcaagauccccgugcagauggcgguggacaugcagacccugaccccggucggccggcugaucacggccaaccccgugaucaccgagagcaccgagaacuccaagaugaugcucgagcuggacccgcccuucggggacagcuacaucgugaucggcgucggggacaagaagaucacccaccacuggcaccgcuccggcagcacgaucgggaaggccuucgaggccaccgugcggggcgccaagcgcauggcggugcugggcgacaccgccugggacuucgggagcgucggcgggguguucaacucccucggcaaggggauccaccagaucuucggcgccgccuucaagagccuguucggcgggauguccugguucagccagauccugaucggcacccugcucguguggcuggggcugaacacgaagaacggcuccaucagccugaccugccucgcccucgggggcgucaugaucuuccucuccaccgcggugagcgcc

SEQ ID NO: 1263 - RNA, 2061 nt, Artificial Sequence
  KX694534.2 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggccgggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1264 - RNA, 2061 nt, Artificial Sequence
  KX369547.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggccuggcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgcc

SEQ ID NO: 1265 - RNA, 2061 nt, Artificial Sequence
  KX447515.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacugguaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1266 - RNA, 2061 nt, Artificial Sequence
  KU729218.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacacccagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgcc

SEQ ID NO: 1267 - RNA, 2061 nt, Artificial Sequence
  KU501217.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgagauccgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgcc

SEQ ID NO: 1268 - RNA, 2061 nt, Artificial Sequence
  KU312314.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugcuggcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgcc

SEQ ID NO: 1269 - RNA, 2061 nt, Artificial Sequence
  KX446950.2 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgacccuggacgagggcguggagcccgacgacgucgacugcuggugcaacaccaccagcacgugggugguguacgggaccugccaccacaagaagggggaggcgcggcgcucccggcgcgccgucacccuccccagccacuccacccggaagcugcagacgcgcagccagaccuggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcacgugggucgacguggugcuggagcacgggggcugcgucaccgugauggcccaggacaagcccaccguggacaucgagcuggucaccacgaccgugagcaacauggccgaggugcgcuccuacugcuacgaggccagcaucuccgacauggccagcgacagccggugccccacccagggggaggcguaccucgacaagcaguccgacacccaguacgucugcaagcgcacgcugguggaccggggcuggggcaacgggugcggccuguucgggaagggcagccucgugaccugcgccaaguucgccugcuccaagaagaugaccggcaagagcauccagcccgagaaccuggaguaccgcaucaugcuguccguccacggcagccagcacuccggcaugaucgugaacgacaccgggcacgagacggacgagaaccgggccaaggucgagaucaccccgaacagcccccgcgccgaggcgacccucggcggguucggcucccuggggcuggacugcgagccccggaccggccucgacuucagcgaccuguacuaccugacgaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgcc

SEQ ID NO: 1270 - RNA, 2061 nt, Artificial Sequence
  KY003157.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgucgugagcgcg

SEQ ID NO: 1271 - RNA, 2061 nt, Artificial Sequence
  KX811222.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcgcgugggugguguacgggaccugccaccacaagaagggcgaggcccggcgcucccggcgcgccgucacgcuccccagccacuccacccggaagcugcagacccgcccccagaccuggcuggagagccgggaguacacgaagcaccucauccgcguggagaacuggaucuuccggaacccgggcuucgcccuggcggccgccgccaucgccuggcugcucggguccagcaccucccagaaggugaucuaccuggucaugauccugcucaucgcgcccgccuacagcauccgcugcaucggcguguccaaccgggacuucguggaggggaugagcggcggcaccugggucgacguggugcuggagcacgggggcugcgucaccgugauggcccaggacaagcccacgguggacaucgagcuggucaccaccaccguguccaacauggccgaggugcgcagcuacugcuacgaggccuccaucagcgacauggcguccgacagccggugccccacgcagggggaggccuaccucgacaagcagagcgacacccaguacgucugcaagcgcacccugguggaccggggcuggggcaacgggugcggccuguucgggaagggcucccucgugaccugcgccaaguucgccugcagcaagaagaugacggggaaguccauccagccggagaaccuggaguaccgcaucaugcugagcguccacggcucccagcacagcggcaugaucgugaacgacaccgggcacgagaccgacgagaaccgggccaaggucgagaucacccccaacagcccccgcgcggaggccacgcucggcggguucggcucccuggggcuggacugcgagccccggaccggccucgacuucuccgaccuguacuaccugaccaugaacaacaagcacuggcucgugcacaaggagugguuccacgacaucccgcugcccuggcacgccggcgccgacaccgggacgccccacuggaacaacaaggaggcccugguggaguucaaggacgcgcacgccaagcgccagaccgucguggugcucggcagccaggagggggccguccacaccgcccuggcgggcgcccuggaggccgagauggacggggccaagggccgccucuccagcggccaccugaagugccggcugaagauggacaagcuccgccugaaggggguguccuacagccugugcaccgccgcguucacguucaccaagauccccgccgagacccuccacggcaccgugaccgucgaggugcaguacgccgggacggacggcccgugcaaggugcccgcccagauggccgucgacaugcagacccugacccccgugggccggcugaucaccgcgaaccccgugaucacggaguccaccgagaacagcaagaugaugcucgagcuggacccgcccuucggggacuccuacaucgucaucggcgugggggagaagaagaucacccaccacuggcaccgcagcggcuccaccaucgggaaggccuucgaggccacggugcggggcgccaagcgcauggccguccugggcgacaccgcgugggacuucgggagcgugggcggggcccucaacagccugggcaaggggauccaccagaucuucggcgccgccuucaagucccuguucggcgggaugagcugguucucccagauccugaucggcacccuccugauguggcuggggcucaacaccaagaacggcagcaucucccugaugugccuggcgcucgggggcgugcugaucuuccugagcacggccgucuccgcc

SEQ ID NO: 1272 - RNA, 2061 nt, Artificial Sequence
  KX447516.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagcaagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1273 - RNA, 2061 nt, Artificial Sequence
  KX520666.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccacccgccagaaggugaucuaccuggucaugauccugcucaucgccccggcguacagcauccggugcaucggcguguccaaccgcgacuucguggaggggaugagcggcggcaccugggucgacguggugcuggagcacgggggcugcgucacggugauggcccaggacaagcccaccguggacaucgagcuggucaccaccacgguguccaacauggccgaggugcggagcuacugcuacgaggccuccaucagcgacauggccuccgacagccgcugccccacccagggggaggcguaccucgacaagcagagcgacacccaguacgucugcaagcggacccugguggaccgcggcuggggcaacgggugcggccuguucgggaagggcucccucgugacgugcgccaaguucgccugcagcaagaagaugaccgggaaguccauccagcccgagaaccuggaguaccggaucaugcugagcguccacggcucccagcacagcggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccggcucuccagcggccaccugaagugccgccugaagauggacaagcuccggcugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucgggaaggcguucgaggccaccgugcgcggcgccaagcggauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgcc

SEQ ID NO: 1274 - RNA, 2061 nt, Artificial Sequence
  KU497555.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcacccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcuccaccaucgggaaggcguucgaggccaccgugcggggcgccaagcgcauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacgcuccugauguggcuggggcucaacaccaagaacggcagcaucucccugaugugccuggcccucgggggcgugcugaucuuccugagcaccgcggucuccgcc

SEQ ID NO: 1275 - RNA, 2061 nt, Artificial Sequence
  KY075939.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacucccugcgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgcc

SEQ ID NO: 1276 - RNA, 2061 nt, Artificial Sequence
  KY075932.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcaucgagaacuggaucuuccggaaccccggcuucgcccuggccgcggccgccaucgccuggcugcucgggagcuccaccagccagaaggugaucuaccuggugaugauccugcucaucgccccggcguacuccauccgcugcaucggcgucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgcc

SEQ ID NO: 1277 - RNA, 2061 nt, Artificial Sequence
  KU870645.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauccugcggaaccccggcuucgcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcaucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgcc

SEQ ID NO: 1278 - RNA, 2061 nt, Artificial Sequence
  KU729217.2 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucagcaccaccguguccaacauggccgaggugcgcagcuacugcuacgaggccacgaucuccgacaucgccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgccgucgugcucggcucccaggagggggccgugcacaccgcccuggcgggcgcccuggaggccgagauggacggggccaagggccgccucagcuccggccaccugaagugccggcugaagauggacaagcuccgccugaagggggucagcuacucccugugcaccgccgcguucaccuucaccaagauccccgccgagacccuccacggcaccgugacgguggagguccaguacgccgggaccgacggccccugcaaggugccggcccagauggccguggacaugcagacccugacccccgucggccggcugaucacggcgaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggccuucgaggccaccgugcggggcgccaagcgcauggccgugcugggcgacaccgcgugggacuucgggagcgucggcggggcccucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcgcucgggggcgugcugaucuuccuguccaccgccgugagcgcc

SEQ ID NO: 1279 - RNA, 2061 nt, Artificial Sequence
  KX087101.3 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgagcugcaguacgccgggaccgacggccccugcaaggugccggcccagauggccguggacaugcagacccugacccccgucggccggcucaucacggccaaccccgugaucaccgagagcaccgagaacuccaagaugaugcuggagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgcc

SEQ ID NO: 1280 - RNA, 2061 nt, Artificial Sequence
  KY014317.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaucgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgcc

SEQ ID NO: 1281 - RNA, 2061 nt, Artificial Sequence
  KU758876.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggugaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagcuucaugugccuggcccucgggggcguccugaucuuccuguccaccgccgugagcgcg

SEQ ID NO: 1282 - RNA, 2061 nt, Artificial Sequence
  KU758874.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggcaagcucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1283 - RNA, 2061 nt, Artificial Sequence
  KY317939.1 prME-short CDS GC
accagcgugggcaucgucgggcugcuccugaccacggccauggccgcggaggugacccgccggggcuccgccuacuacauguaccuggaccgcaaggacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1284 - RNA, 2061 nt, Artificial Sequence
  KY014314.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggaggcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1285 - RNA, 2061 nt, Artificial Sequence
  KX447517.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcggcccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagacccugaucggcacccuccugauguggcuggggcucaacacgaagaacggcuccaucagccugaugugccuggcgcucgggggcgugcugaucuuccuguccaccgccgucagcgcc

SEQ ID NO: 1286 - RNA, 2061 nt, Artificial Sequence
  KU926310.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccggggccgacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgcc

SEQ ID NO: 1287 - RNA, 2061 nt, Artificial Sequence
  KU922923.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgcccuggcguacuccauccgcugcaucggcgugagcaaccgggacuucguggaggggauguccggcggcaccugggucgacguggugcuggagcacgggggcugcgucacggugauggcccaggacaagccgaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgcccaacagcccgcgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugcccuggcacgccggcgccgacacggggaccccgcacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcacggccgccuucaccuucaccaagauccccgcggagacccugcacggcaccgugacggucgaggugcaguacgccgggaccgacggccccugcaaggugcccgcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgcc

SEQ ID NO: 1288 - RNA, 2061 nt, Artificial Sequence
  KY075937.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggucagcgacagccggugccccacccagggggaggccuaccucgacaagcaguccgacacccaguacgugugcaagcgcacccugguggaccggggcuggggcaacgggugcggccuguucgggaagggcagccucgucacgugcgcgaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggccacccucggcggguucggcucccuggggcuggacugcgagccccggaccggccucgacuucagcgaccuguacuaccugaccaugaacaacaagcacuggcucgugcacaaggagugguuccacgacaucccccugccguggcacgcgggcgccgacacggggacgccccacuggaacaacaaggaggcccuggucgaguucaaggacgcccacgccaagcgccagaccguggugguccucggcucccaggagggggcggugcacaccgcccuggccggcgcccuggaggcggagauggacggggccaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagccugaugugccuggcccucgggggcguccugaucuuccuguccaccgccgugagcgcg

SEQ ID NO: 1289 - RNA, 2061 nt, Artificial Sequence
  KY003156.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcaucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcauccuggggcuggacugcgagccccggaccggccucgacuucuccgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcagccaggagggggccgugcacaccgcccuggccggcgcgcuggaggccgagauggacggggccaagggccgccucuccagcggccaccugaagugccggcugaagauggacaagcuccgccugaagggggucuccuacagccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcuccacgaucgggaaggcguucgaggccaccgugcggggcgccaagcgcauggccgugcugggcgacaccgccugggacuucgggagcgucggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcgguguccgcc

SEQ ID NO: 1290 - RNA, 2061 nt, Artificial Sequence
  KU312313.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacacgugcgacgccaccauguccuacgagugcccgaugcuggacgagggcguggagcccgacgacgucgacugcuggugcaacaccaccagcacgugggugguguacgggaccugccaccacaagaagggggaggcgcggcgcucccggcgcgccgucacccuccccagccacuccauccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacggcagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacgccaagaacggcuccaucagccugaugugccuggcgcucgggggcgugcugaucuuccuguccacggccgucagcgcc

SEQ ID NO: 1291 - RNA, 2061 nt, Artificial Sequence
  KY075935.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcagcggucccgccgggccgucacccuccccagccacuccacccgcaagcugcagacccggagccagacguggcuggagucccgcgaguacaccaagcaccucauccggguggagaacuggaucuuccgcaaccccggcuucgcccuggccgcggccgccaucgccuggcugcucgggagcuccaccagccagaaggugaucuaccuggucaugauccugcucaucgccccggcguacuccauccggugcaucggcgugagcaaccgcgacuucguggaggggauguccggcggcaccugggucgacguggugcuggagcacgggggcugcgucacggugauggcccaggacaagcccaccguggacaucgagcuggucaccaccacggugagcaacauggccgaggugcgguccuacugcuacgaggccagcaucuccgacauggccagcgacagccgcugccccacccagggggaggcguaccucgacaagcaguccgacacccaguacgucugcaagcggacccugguggaccgcggcuggggcaacgggugcggccuguucgggaagggcagccucgugacgugcgccaaguucgccugcuccaagaagaugaccggcaagagcauccagcccgagaaccuggaguaccggaucaugcuguccguccacgggagccagcacuccggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcggcagaccgucguggugcucggcucccaggagggggccguccacaccgcccuggccggcgcgcuggaggccgagauggacggggccaagggccgccucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1292 - RNA, 2061 nt, Artificial Sequence
  KY014320.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcaggcccgcagccagaccuggcuggagucccgggaguacacgaagcaccucauccgcguggagaacuggaucuuccggaaccccggcuucgcccuggcggccgccgccaucgccuggcugcucgggagcuccaccagccagaaggugaucuaccuggucaugauccugcucaucgcgccggccuacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggcgagcgacagccggugccccacgcagggggaggccuaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacgggagccagcacuccggcaugaucgugaacgacaccgggcacgagaccgacgagaaccgggccaaggucgagaucaccccgaacagcccccgcgcggaggccacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgcc

SEQ ID NO: 1293 - RNA, 2061 nt, Artificial Sequence
  KY328290.1 prME-short CDS GC
accagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucuccaagauccccgcggagacccuccacggcaccgugaccgaggagguccaguacgccgggacggacggccccugcaaggugccggcccagauggccguggacaugcagacccugacccccgucggccggcugaucaccgccaaccccgugaucacggagagcaccgagaacuccaagaugaugcucgagcuggacccgcccuucggggacagcuacaucgugaucggcgucggggagaagaagaucacccaccacuggcaccgcagcggcuccaccaucgggaaggcguucgaggccacggugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggugagcgcc

SEQ ID NO: 1294 - RNA, 2061 nt, Artificial Sequence
  KU681081.3 prME-short CDS GC
accagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacacgggcgccgacaccgggacgccccacuggaacaacaaggaggcccugguggaguucaaggacgcccacgccaagcgccagaccgucguggugcucggcagccaggagggggcgguccacaccgcccuggccggcgcccuggaggcggagauggacggggccaagggccgccucuccagcggccaccugaagugccggcugaagauggacaagcuccgccugaaggggguguccuacagccugugcaccgccgccuucaccuucaccaagauccccgccgagacccuccacggcacggugaccgucgaggugcaguacgcggggaccgacggccccugcaaggugccggcccagauggccgucgacaugcagacccugacgcccgugggccggcugaucaccgccaaccccgugaucaccgaggggaccgagaacuccaagaugaugcucgagcuggacccgcccuucggcgacagcuacaucgucaucggggugggcgagaagaagaucacgcaccacuggcaccgcuccgggagcaccaucggcaaggccuucgaggcgaccgugcggggcgccaagcgcauggccguccugggggacaccgccugggacuucggcagcgucgggggcgugcucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgcc

SEQ ID NO: 1295 - RNA, 2061 nt, Artificial Sequence
  KX827309.1 prME-short CDS GC
accagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgcc

SEQ ID NO: 1296 - RNA, 2061 nt, Artificial Sequence
  KU955593.1 prME-short CDS GC
accagcgugggcaucgucgggcugcuccugaccacggccauggccguggaggugacccgccggggcaacgcguacuacauguaccuggaccgcuccgacgccggggaggccaucagcuuccccaccaccaugggcaugaacaagugcuacauccagaucauggaccucgggcacaugugcgacgccacgauguccuacgagugcccgaugcuggacgagggcgucgagcccgacgacguggacugcuggugcaacaccaccagcaccuggguggucuacggcacgugccaccacaagaagggggaggcccggcgcucccggcgcgcggugacccugcccagccacuccacccggaagcuccagacccgcagccagacguggcuggagucccgggaguacaccaagcaccugauccgcguggagaacuggaucuuccggaaccccggcuucgcccucgccgccgcggccaucgccuggcugcuggggagcuccaccagccagaaggucaucuaccucgugaugauccugcugaucgccccggccuacuccauccgcugcaucggcgugagcaaccgggacuucgucgaggggauguccggcggcaccuggguggacgugguccucgagcacgggggcugcgugacggugauggcgcaggacaagcccaccgucgacaucgagcuggugaccaccacggugagcaacauggccgagguccgcuccuacugcuacgaggccagcaucuccgacauggccagcgacagccggugccccacccagggggaggccuaccuggacaagcaguccgacacccaguacgugugcaagcgcacccucguggaccggggcuggggcaacgggugcggccuguucgggaagggcagccuggucacgugcgcgaaguucgccugcuccaagaagaugaccggcaagagcauccagcccgagaaccucgaguaccgcaucaugcuguccgugcacgggagccagcacuccggcaugaucgucaacgacaccgggcacgagaccgacgagaaccgggccaagguggagaucacgccgaacagcccccgcgccgaggccacccugggcggguucggcucccucgggcuggacugcgagccccggaccggccuggacuucagcgaccucuacuaccugaccaugaacaacaagcacuggcuggugcacaaggagugguuccacgacaucccccucccguggcacgcgggcgccgacacggggacgccccacuggaacaacaaggaggcccuggucgaguucaaggacgcccacgccaagcgccagaccguggugguccugggcucccaggagggggcggugcacaccgcccucgccggcgcccuggaggcggagauggacggggccaagggccgccugagcuccggccaccucaagugccggcugaagauggacaagcugcgccucaagggggugagcuacucccugugcaccgccgccuucaccuucaccaagauccccgccgagacccugcacggcaccgucacgguggaggugcaguacgcggggaccgacggccccugcaaggucccggcccagauggccguggacaugcagacccucacccccgugggccggcugaucacggccaaccccgucaucaccgagagcaccgagaacuccaagaugaugcuggagcucgacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccugaacucccucggcaaggggauccaccagaucuucggcgcggccuucaagagccuguucggcgggauguccugguucagccagauccugaucggcacccugcucgucuggcuggggcugaacacgaagaacggcuccaucagccucaugugccuggcccucgggggcgugcugaucuuccuguccaccgccgugagcgcg

SEQ ID NO: 1297 - RNA, 2061 nt, Artificial Sequence
  KY272987.1 prME-short CDS GC
accagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccuggugugccuggcccucgggggcguccugaucuuccugagcaccgcgguguccgcc

SEQ ID NO: 1298 - RNA, 2061 nt, Artificial Sequence
  KY007221.1 prME-short CDS GC
accagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcgugaacaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccuggugugccuggcccucgggggcguccugaucuuccuguccaccgcggugagcgcc

SEQ ID NO: 1299 - RNA, 2061 nt, Artificial Sequence
  EU545988.1 prME-short CDS GC
accagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggccaucgccuggcugcucggguccagcaccucccagaaggucaucuaccuggugaugauccugcucaucgccccggccuacagcauccgcugcaucggcguguccaaccgggacuucgucgaggggaugagcggcggcaccuggguggacgugguccuggagcacgggggcugcgugacggugauggcgcaggacaagcccgccgucgacaucgagcuggugaccaccaccguguccaacauggccgagguccgcagcuacugcuacgaggccuccaucagcgacauggccagcgacucccggugccccacgcagggggaggcguaccucgacaagcagagcgacacccaguacgugugcaagcgcacccugguggaccggggcuggggcaacgggugcggccuguucgggaagggcucccucgugaccugcgccaaguucgccugcagcaagaagaugacggggaaguccauccagcccgagaaccuggaguaccgcaucaugcugagcguccacggcucccagcacagcggcaugaucgucaacgacaccgggcacgagaccgacgagaaccgggccaagguggagaucaccccgaacagcccccgcgccgaggcgacgcucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacaccgggacgccccacuggaacaacaaggaggcccuggucgaguucaaggacgcccacgcgaagcgccagaccguggugguccucggcagccaggagggggccgugcacaccgcccuggccggcgcgcuggaggccgagauggacggggccaagggccgccucuccagcggccaccugaagugccggcugaagauggacaagcuccgccugaaggggguguccuacagccugugcaccgccgccuucacguucaccaagauccccgcggagacccuccacggcaccgucaccguggaggugcaguacgccgggacggacggccccugcaaggucccggcccagauggccguggacaugcagacccugacccccgugggccggcugaucaccgccaaccccgucaucacggaguccaccgagaacagcaagaugaugcucgagcuggacccgcccuucggggacuccuacaucgugaucggcgugggggagaagaagaucacccaccacuggcaccgcagcggcagcaccaucgggaaggcguucgaggccacgguccggggcgccaagcgcauggccgugcugggcgacaccgccugggacuucggguccgugggcggggcgcucaacagccugggcaaggggauccaccagaucuucggcgccgccuucaagucccuguucggcgggaugagcugguucucccagauccugaucggcacccuccuggucuggcuggggcucaacaccaagaacggcagcaucucccugacgugccuggcccucgggggcgugcugaucuuccugagcaccgcgguguccgcc

SEQ ID NO: 1300 - RNA, 2061 nt, Artificial Sequence
  KU681082.3 prME-short CDS GC
accagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggucaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcccaggacaagcccaccguggacaucgagcuggugaccaccacggucuccaacauggcggaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgccaaguucgcgugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgccggcgcggacacggggacgccccacuggaacaacaaggaggcccugguggaguucaaggacgcccacgccaagcgccagaccguggucgugcucggcagccaggagggggccgugcacaccgcgcuggccggcgcccuggaggccgagauggacggggcgaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgccgggaccgacggccccugcaaggugccggcgcagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcagcacgaucgggaaggccuucgaggccaccgugcggggcgcgaagcgcauggccgugcugggcgacaccgccugggacuucggguccgucggcggggcccucaacagccugggcaaggggauccaccagaucuucggcgccgcguucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgcc

SEQ ID NO: 1301 - RNA, 2061 nt, Artificial Sequence
  KX601167.1 prME-short CDS GC
accagcgugggcaucgucgggcugcuccugaccacggccauggccguggaggugacccgccggggcuccgcguacuacauguaccuggaccgcagcgacgccggggaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacacggggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgcggggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggacaagaagaucacccaccacugguaccgcagcggcagcacgaucgggaaggccuucgaggcgaccgugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgcg

SEQ ID NO: 1302 - RNA, 2061 nt, Artificial Sequence
  KX694533.2 prME-short CDS GC
accagcgugggcaucgucgggcugcuccugaccacggccauggccguggaggugacccgccggggcuccgcguacuacauguaccuggaccgcagcgacgccgggaaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaucgggcacgagaccgacgagaaccgggccaagguggagaucaccccgaacagcccccgcgccgaggccacgcucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacaccgggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucacguucaccaagauccccgccgagacccuccacggcaccgugaccguggagguccaguacgcggggacggacggccccugcaaggugccggcccagauggccguggacaugcagacccugacccccgucggccggcugaucaccgccaaccccgugaucacggaguccaccgagaacagcaagaugaugcucgagcuggacccgcccuucggggacuccuacaucgugaucggcgucggggacaagaagaucacccaccacuggcaccgcagcggcagcaccaucgggaaggccuucgaggcgacggugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacaccaagaacggcagcaucucccugacgugccuggcccucgggggcgugcugaucuuccugagcaccgccgucuccgcg

SEQ ID NO: 1303 - RNA, 2061 nt, Artificial Sequence
  KY288905.1 prME-short CDS GC
accagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgcgaagguggaggucacccccaacuccccgcgggccgaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcgcugguggaguucaaggacgcccacgccaagcggcagacggucguggugcucggcagccaggagggggccguccacaccgcccuggcgggcgcccuggaggccgagauggacggggccaagggccgccucuucuccggccaccugaagugccgccugaagauggacaagcuccggcugaagggggugagcuacucccugugcaccgcggccuucaccuucaccaaggugcccgccgagacgcuccacggcaccgucaccguggaggugcaguacgccgggaccgacggccccugcaagguccccgcccagauggcgguggacaugcagacgcugaccccggugggccgccugaucaccgccaaccccgucaucaccgagagcacggagaacuccaagaugaugcucgagcuggacccgcccuucggggacagcuacaucgugaucggcgugggggacaagaagaucacccaccacuggcaccgguccggcagcaccaucgggaaggccuucgaggccaccguccgcggcgccaagcggauggcggugcugggcgacacggccugggacuucgggagcgugggcggggucuucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgugaugaucuuccucuccacggcggucagcgcc

SEQ ID NO: 1304 - RNA, 2061 nt, Artificial Sequence
  KF268950.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggggaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaaggucgaggugacccccaacuccccgcgggccgaggccacgcucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacaccgggacgccgcacuggaacaacaaggaggcccuggucgaguucaaggacgcccacgccaagcggcagaccguggugguccucggcagccaggagggggcggugcacaccgcccuggccggcgcccuggaggcggagauggacggggccaagggccgccucuucuccggccaccugaagugccgccugaagauggacaagcuccggcugaagggggugagcuacucccugugcaccgccgccuucacguucaccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaagggggugcaccagaucuucggcgccgcguucaagagccuguucggcgggauguccugguucagccagauccugaucggcacccugcucgucuggcuggggcugaacaccaagaacggcuccaucagccucacgugccuggcccugggcggcgugaugaucuuccucuccaccgccgugagcgcc

SEQ ID NO: 1305 - RNA, 2061 nt, Artificial Sequence
  KF383121.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaucgggcacgagaccgacgagaaccgcgccaagguggaggugacccccaacuccccgcgggccgaggccacccucggcggguucggcagccuggggcuggacugcgagccccgcaccggccucgacuucuccgaccuguacuaccugaccaugaacaacaagcacuggcucguccacaaggagugguuccacgacaucccccugcccuggcacgccggcgcggacacggggaccccgcacuggaacaacaaggaggcccugguggaguucaaggacgcccacgccaagcggcagaccguggucgugcucggcagccaggagggggccgugcacaccgcgcuggccggcgcccuggaggccgagauggacggggcgaagggccgccucuucuccggccaccugaagugccgccugaagauggacaagcuccggcugaagggggucagcuacucccugugcacggccgccuucaccuucaccaaggugcccgccgagacccuccacggcaccgugacggucgaggugcaguacgccgggaccgacggccccugcaaggugcccgcgcagauggccgucgacaugcagacccugaccccggugggccgccugaucacggccaaccccgugaucaccgagagcaccgagaacuccaagaugaugcucgagcuggacccgcccuucggggacagcuacaucgucaucggcgugggggacaagaagaucacccaccacuggcaccgguccggcagcacgaucgggaaggccuucgaggccaccgugcgcggcgcgaagcggauggccguccugggcgacaccgccugggacuucgggagcgugggcgggguguucaacucccucggcaaggggauccaccagaucuucggcgccgccuucaagagccuguucggcgggauguccugguucagccagauccugaucggcacccugcucgucuggcuggggcugaacacgaagaacggcuccaucagccugaccugccuggcgcucgggggcgugaugaucuuccucuccaccgccgugagcgcc

SEQ ID NO: 1306 - RNA, 2043 nt, Artificial Sequence
  KF268949.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggcgaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgccaaggucgaggugacccccaacuccccgcgggccgaggccacccucgggggcuucgggagccugggccuggacugcgagccccgcacggggcucgacuucuccgaccuguacuaccugaccaugaacaacaagcacuggcucgugcacaaggagugguuccacgacaucccccugcccuggcacgcgggcgccgacaccggcaccccgcacuggaacaacaaggaggcccuggucgaguucaaggacgcccacgccaagcggcagacgguggugguccucgggagccaggagggcgcggugcacaccgcccuggccggggcccuggaggcggagauggacggcgccaaggggcgccucuucuccggccaccugaagugccgccugaagauggacaagcuccggcugaagggcgugagcuacucccugugcaccgccgccuucaccuucacgaagguccccgccgagacccuccacgggaccgugaccguggagguccaguacgcgggcaccgacgggcccugcaaggugcccgcccagauggccguggacaugcagacgcugaccccggucggccgccugaucaccgccaaccccgugaucaccgagagcacggagaacuccaagaugaugcucgagcuggacccgcccuucggcgacagcuacaucgugaucggggucggcgacaagaagaucacccaccacuggcaccgguccgggagcaccaucggcaaggccuucgaggcgaccgugcgcggggccaagcggauggccgugcugggcgacacggccugggacuucggcagcgucgggggcguguucaacucccucgggaagggcauccaccagaucuucggggccgcguucaagagccuguucggcggcauguccugguucagccagauccugaucgggacccugcucguguggcugggccugaacaccaagaacggguccaucagccugaccugccucgcccugggcggggucaugaucuuccucuccacggccgugagcgcc

SEQ ID NO: 1307 - RNA, 2061 nt, Artificial Sequence
  KU955595.1 prME-short CDS GC
accagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugacgaugaacaacaagcacuggcucgugcacaaggagugguuccacgacaucccccugcccuggcacgccggcgcggacaccgggaccccgcacuggaacaacaaggaggcccugguggaguucaaggacgcccacgccaagcggcagaccgucguggugcucggcagccaggagggggccguccacacggcgcuggccggcgcccuggaggccgagauggacggggcgaagggccgccucuucuccggccaccugaagugccgccugaagauggacaagcuccggcugaagggggugagcuacucccugugcaccgccgccuucaccuucaccaaggugcccgccgagacccuccacggcacggucaccguggaggugcaguacgccgggaccgacggccccugcaagguccccgcgcagauggccguggacaugcagacccugacgccggugggccgccugaucaccgccaaccccgucaucaccgagagcaccgagaacuccaagaugaugcucgagcuggacccgcccuucggggacagcuacaucgugaucggcgugggggacaagaagaucacgcaccacuggcaccgguccggcagcaccaucgggaaggccuucgaggccaccguccgcggcgcgaagcggauggccgugcugggcgacaccgccugggacuucgggagcgugggcggggucuucaacucccucggcaaggggauccaccagaucuucggcgccgccuucaagagccuguucggcgggauguccugguucagccagauccugaucggcacgcugcucguguggcuggggcugaacaccaagaacggcuccaucagccugaccugccuggcgcucgggggcgugaugaucuuccucuccaccgccgucagcgcc

SEQ ID NO: 1308 - RNA, 2061 nt, Artificial Sequence
  KF383116.1 prME-short CDS GC
accagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccagcacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccugguggaguucaaggacgcccacgccaagcggcagaccgucguggugcucggcagccaggagggggccguccacaccgcgcuggccggcgcccuggaggccgagauggacggggcgaagggccgccucuucuccggccaccugaagugccgccugaagauggacaagcuccggcugaagggggugagcuacucccugugcacggccgugugcaccgccgccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaaggggauccaccagaucuucggcgccgcguucaagagccuguucggcgggauguccugguucagccagauccugaucggcacccugcucguguggcuggggcugaacaccaagaacggcuccaucagccucacgugccuggcccucgggggcgucaugaucuuccuguccaccgccgugagcgcc

SEQ ID NO: 1309 - RNA, 2043 nt, Artificial Sequence
  KX601166.1 prME-short CDS GC
accagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacgagaaccgcgccaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgcggacaccggcacgccgcacuggaacaacaaggaggcccugguggaguucaaggacgcccacgccaagcggcagaccgucguggugcucgggagccaggagggcgccguccacaccgcgcuggccggggcccuggaggccgagauggacggcgcgaaggggcgccucuucuccggccaccugaagugccgccugaagauggacaagcuccggcugaagggcgugagcuacucccugugcaccgccgccuucacguucaccaaggugcccgccgagacccuccacgggaccgucaccguggaggugcaguacgccggcacggacgggcccugcaagguccccgcgcagauggccguggacaugcagacccugaccccggugggccgccugaucaccgccaaccccgucaucacggagagcaccgagaacuccaagaugaugcucgagcuggacccgcccuucggcgacagcuacaucgugaucggggugggcgacaagaagaucacccaccacuggcaccgguccgggagcaccaucggcaaggccuucgaggccacgguccgcggggcgaagcggauggccgugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacaccaagaacggguccaucagccucacgugccuggcgcugggcggggugaugaucuuccucuccaccgccgucagcgcc

SEQ ID NO: 1310 - RNA, 2061 nt, Artificial Sequence
  KF383118.1 prME-short CDS GC
accagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagccggacgacguggacugcuggugcaacaccaccuccaccugggucguguacggcacgugccaccacaagaagggggagacccggcgcagccggcgcuccgugagccuccgguaccacuacacccgcaagcugcagacccggucccagacguggcuggagagccgcgaguacaagaagcaccucaucauggucgagaacuggaucuuccggaaccccggcuucgccaucguguccguggccaucaccuggcugauggggagccugaccucccagaaggucaucuaccucgugaugaucgugcugaucguccccgccuacagcaucuccugcaucggcgugagcaaccgcgaccugguggaggggauguccggcggcaccugggucgacguggugcucgagcacgggggcugcgucacggagauggcgcaggacaagcccaccguggacaucgagcuggugaccaugaccgucagcaacauggccgaggugcgguccuacugcuacgaggccagccugagcgacauggccuccgccagccgcugcccgacgcagggggagcccucccucgacaagcagagcgacacccaguccgugugcaagcggacccugggcgaccgcggcugggggaacggcugcgggaucuucggcaaggggagccuggugaccugcuccaaguucacgugcugcaagaagaugcccggcaagagcauccagcccgagaaccucgaguaccggaucaugcugccggugcacggcucccagcacagcgggaugaucgucaacgacaucggccacgagaccgacgagaaccgcgcgaagguggaggugacccccaacagcccccgggccgaggccacccucgggggcuucgggucccugggccuggacugcgagccccgcacgggccuggacuucuccgaccucuacuaccugaccaugaacaacaagcacuggcugguccacaaggagugguuccacgacaucccgcuccccuggcacgccggggccgacaccggcacgccccacuggaacaacaaggaggcgcugguggaguucaaggacgcccacgccaagcggcagaccguggucgugcuggggagccaggagggcgccgugcacaccgcccucgcgggggcccuggaggccgagauggacggcgccaagggccgccuguucuccgggcaccucaagugccgccugaagauggacaagcugcggcucaagggcgucagcuacucccugugcaccgccgcguucaccuucacgaaggugcccgccgagacccugcacgggaccgugaccgucgaggugcagagcgccggcaccgacggcccgugcaaggugcccgcccagauggcggucgacaugcagacgcucacccccguggggcgccugaucaccgccaaccccgugaucaccgaguccacggagaacagcaagaugaugcuggagcucgacccgcccuucggcgacagcuacaucgucaucggggugggcgacaagaagaucacccaccacuggcaccgguccgggagcaccaucggcaaggccuucgaggccaccgugcgcggcgccaagcggauggcgguccugggggacacggccugggacuucggcuccgucgggggcguguucaacagccuggggaagggcauccaccagaucuucggcgccgccuucaagucccucuucgggggcaugagcugguucucccagauccugaucgggacccugcuggucuggcucggccugaacaccaagaacgggagcaucucccugaccugccucgcccugggcggcgugaugaucuuccugagcacggcgguguccgcc

SEQ ID NO: 1311 - RNA, 2058 nt, Artificial Sequence
  KX447520.1 prME-short CDS GC
agcgugggcaucgucgggcugcuccugaccaccgccauggccgcggaggugacgcgccggggcuccgccuacuacauguaccuggaccgcaacgacgccggggaggccaucagcuuccccaccacccucggcaugaacaagugcuacauccagaucauggaccuggggcacaugugcgacgccaccauguccuacgagugcccgaugcuggacgagggcguggagcccgacgacgucgacugcuggugcaacacgaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgcc

SEQ ID NO: 1312 - RNA, 2061 nt, Artificial Sequence
  KU761561.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgcccgccggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1313 - RNA, 2061 nt, Artificial Sequence
  KX806557.2 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauguuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgcc

SEQ ID NO: 1314 - RNA, 2061 nt, Artificial Sequence
  LC191864.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaugaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgcc

SEQ ID NO: 1315 - RNA, 2061 nt, Artificial Sequence
  KU744693.1 prME-short CDS GC
accagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggccauggcccaggacaagcccaccguggacaucgagcuggugaccaccacggucagcaacauggccgaggugcgcuccuacugcuacgaggccagcaucuccgacauggcgagcgacagccggugccccacccagggggaggccuaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugcucgucaacgacaccgggcacgagaccgacgagaaccgggccaagguggagaucacgccgaacagcccccgcgcggaggccacccugggcggguucggcucccuggggcucgacugcgagccccggaccggccuggacuucagcgaccuguacuaccucaccaugaacaacaagcacuggcuggcccacaaggagugguuccacgacaucccccugccguggcacgccggcgccgcgacggggacgccccacuggaacaacaaggaggcccucgucgaguucaaggacgcccacgccaagcgccagaccguggugguccugggcucccaggagggggcggugcacaccgcccuggccggcgcccucgaggccgagauggacggggcgaagggccgccugagcuccggccaccugaagugccggcucaagauggacaagcugcgccugaagggggugagcuacucccucugcaccgccgccuucaccuucaccaagauccccgccgagaccgucgacggcaccgugacgguggaggggcaguacggcggcaccgacgggcccugcaaggucccggcccagauggcgguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucggcaaggccuucgaggccaccguccgcggggccaagcggauggcggugcugggcgacaccgccugggacuucgggagcgugggcggggcccucaacucccugggcaagggcauccaccagaucaucggggccgcguucaagagccuguucggcgggauguccugguucagccagauccugaucggcacccuccugauguggcuggggcucaacacgaagaacggcuccaucagccugaugugccuggcccucggcgggguccugaucuuccuguccaccgccgugagcggc

SEQ ID NO: 1316 - RNA, 2052 nt, Artificial Sequence
  KU963574.2 prME-short CDS GC
ggcgccgacgccagcaucgggaucgugucccugcuccugaccaccgucauggcggccgagaucacgcgccggggcagcgccuacuacauguaccuggaccgcuccgacgccgggaaggccaucagcuucgugaccacccucggcgugaacaagugccacguccagaucauggaccuggggcacaugugcgacgcgaccauguccuacgagugccccaugcuggacgagggcguggagcccgacgacguggacugcuggugcaacacgaccagcaccugggucguguacgggaccugccaccacaagaagggggaggcccggcgcucccggcgcgccgugacgcuccccagccacuccacccggaagcugcagacccgcagccagaccuggcuggagucccgggaguacacgaagcaccucaucaaggucgagaacuggaucuuccgcaaccccggcuucgcccugguggcgguggccaucgccuggcugcucgggagcuccaccagccagaaggucaucuaccuggugaugauccugcucaucgcccccgccuacuccauccggugcaucggcgugagcaaccgcgacuucgucgaggggauguccggcggcaccuggguggacgugguccuggagcacgggggcugcgugaccgugauggcgcaggacaagccgacggucgacaucgagcuggugaccaccaccgugagcaacauggccgagguccgguccuacugcuacgaggccagcaucagcgacauggccuccgacagccgcugccccacgcagggggaggccuaccucgacaagcaguccgacacccaguacgugugcaagcggacccuggucgaccgcggcuggggcaacgggugcggccuguucgggaagggcagccucgugaccugcgcgaaguucacgugcuccaagaagaugaccggcaagagcauccagcccgagaaccuggaguaccggaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgccgacaccgagaccccgcacuggaacaacaaggaggcgcugguggaguucaaggacgcccacgccaagcggcagacgguggucgugcucggcagccaggagggggccgugcacaccgcccuggcgggcgcccuggaggccgagauggacggggccaagggccgccucuccagcgggcaccugaagugccgccugaagauggacaagcuccggcugaagggcgucuccuacagccugugcaccgcggccuucaccuucacgaaggugcccgccgagacccuccacggcaccgugaccgucgaggugcaguacgccgggcgcgacggccccugcaaggugcccgcccagauggcggucgacaugcagacccugacgccgguggggcggcugaucaccgccaaccccgugaucaccgaguccaccgagaacagcaagaugaugcucgagcuggacccgcccuucggcgacagcuacaucgucaucggcgugggggacaagaagaucacgcaccacuggcaccgcuccggcagcaucaucgggaaggccuucgaggccaccgugcggggcgccaagcgcauggcgguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcccucgggggcgugaugaucuuccucagcaccgcgguguccgcc

SEQ ID NO: 1317 - RNA, 2070 nt, Artificial Sequence
  KF383120.1 prME-short CDS GC
ggcgccgacaccagcaucgggaucaucggccugcuccugaccacggccauggcggccgagaucacccgccggggguccgccuacuacauguaccuggaccgcagcgacgccggcaaggccaucuccuucgcgaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccggcccagccgccgggccgugacccugcccucccacagcacccgcaagcuccagacccggucccagacguggcuggagagccgcgaguacaccaagcaccugaucaaggucgagaacuggauccuccggaaccccggguucaccguggcggcccuggccauggccuggcugcucggcaacuccaccagccagcgcgugaucuaccuggucaugauccugcucaucgccccggcguacuccauccggugcaucggggugagcaaccgcgacuucguggagggcauguccggcgggacgugggucgacguggugcuggagcacggcgggugcgucaccgugauggcccaggacaagcccaccguggacaucgagcuggucaccacgaccgugagcaacauggccgaggugcgguccuacugcuacgaggccagcaucuccgacauggccagcgacagccgcugccccacccagggcgaggcguaccucgacaagcaguccgacacccaguacgucugcaagcggacgcugguggaccgcggcugggggaacggcugcgggcuguucggcaaggggagccucgugaccugcgccaaguucacgugcuccaagaagaugaccggcaagagcauccagcccgagaaccuggaguaccggaucaugcuguccguccacggcagccagcacuccgggaugaucgugaacgacaucggccacgagaccgacgagaaccgcgccaaggucgaggugaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgcgggggccgacaccggcacgccccacuggaacaacaaggaggcccuggucgaguucaaggacgcccacgccaagcggcagaccguggugguccucgggucccaggagggcgcggugcacaccgcccuggccggggcccuggaggcggagauggacggcgccaagggccgccucuucagcgggcaccugaagugccgcaucaagauggacaagcugcggcucaagggcguguccuacagccugugcaccgccgccuucaccuucuccaagguccccgccgagacccugcacgggaccgugacgguggagguccaguacgcgggccgcgacggccccugcaaggugccggcccagauggccguggacaugcagacccucacccccgucgggcggcugaucaccgccaaccccaucaucacggagagcaccgagaacucccgcaugaugcuggagcucgacccgcccuucggcgacagcuacaucgugaucggggugggcgacaagaagaucacccaccacuggcaccgguccgggagcaccaucggcaaggccuucgaggcgacgguccgcggcgccaagcggauggccgugcugggggacaccgccugggacuucggcagcgucgggggcguguucaacucccuggggaagggcgugcaccagguguucggcgccgcguucaagagccucuucgggggcauguccugguucagccagauccugaucgggacccugcuggucuggcucggccugaacaccaagaacggguccaucagccuggccugccucgcccugggcggcgccaugaucuuccuguccacggcggugagcgcc

SEQ ID NO: 1318 - RNA, 1353 nt, Artificial Sequence; identical to SEQ ID NO: 124
  KU321639.1 solE CDS GC

SEQ ID NO: 1319 - RNA, 1353 nt, Artificial Sequence; identical to SEQ ID NO: 143
  KU312312.1 solE CDS GC

SEQ ID NO: 1320 - RNA, 1341 nt, Artificial Sequence; identical to SEQ ID NO: 162
  AY632535.2 solE CDS GC

SEQ ID NO: 1321 - RNA, 1353 nt, Artificial Sequence; identical to SEQ ID NO: 1096
  KU527068.1 solE CDS GC

SEQ ID NO: 1322 - RNA, 1353 nt, Artificial Sequence
  KX421193.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagc

SEQ ID NO: 1323 - RNA, 1353 nt, Artificial Sequence
  LC002520.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaccgugaacgacaucggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagc

SEQ ID NO: 1324 - RNA, 1335 nt, Artificial Sequence
  DQ859059.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacgcgggcgccgacaccgggaccccgcacuggaacaacaaggaggcccucguggaguucaaggacgcccacgccaagcgccagacggucguggugcugggcagccaggagggggcgguccacaccgcccuggccggcgcccucgaggccgagauggacggcgcgaaggggcggcuguucagcggccaccugaagugccgccucaagauggacaagcugcggcugaaggggguguccuacagccucugcaccgccgccuucaccuucacgaagguccccgccgagacccugcacggcaccgugaccguggagguccaguacgccgggacggacggccccugcaaggugcccgcgcagauggccguggacaugcagacccugaccccggucggccgccucaucaccgccaaccccgugaucacggaguccaccgagaacagcaagaugaugcuggagcuggacccgcccuucggggacuccuacaucgugaucggcgucggggacaagaagaucacccaccacuggcaccggagcggcuccaccaucgggaaggccuucgaggccacggugcgcggcgcgaagcggauggccgugcucggcgacaccgccugggacuucgggagc

SEQ ID NO: 1325 - RNA, 1341 nt, Artificial Sequence
  KU963573.2 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgagaaccgggccaagguggaggugacccccaacuccccgcgcgccgaggccacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggcaagcuguucagcgggcaccugaagugccggcucaagauggacaagcugcgccugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcggcucaucacggccaaccccgucaucaccgaguccaccgagaacagcaagaugaugcuggagcuggacccgcccuucggcgacuccuacaucgugaucggggugggcgacaagaagaucacccaccacuggcaccgcagcggguccacgaucggcaaggccuucgaggccaccguccggggcgccaagcgcauggcggugcucggggacaccgccugggacuucggcagc

SEQ ID NO: 1326 - RNA, 1353 nt, Artificial Sequence
  KY075939.1 solE CDS GC
agccagaaggugaucuaccuggucaugauccuccugaucgcccccgccuacucccugcgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacuccccgcgcgccgaggcgacgcucgggggcuucggcagccuggggcuggacugcgagccccggaccggccuggacuucuccgaccucuacuaccugaccaugaacaacaagcacuggcugguccacaaggagugguuccacgacaucccccuccccuggcacgccggggccgacaccggcacgccgcacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagauccccgccgagacccugcacgggaccgugacggucgaggugcaguacgcgggcaccgacggccccugcaaggugcccgcccagauggccgucgacaugcagacccucaccccgguggggcgccugaucacggccaaccccgugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcucc

SEQ ID NO: 1327 - RNA, 1353 nt, Artificial Sequence
  KX447516.1 solE CDS GC
agcaagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcucc

SEQ ID NO: 1328 - RNA, 1353 nt, Artificial Sequence
  KX447515.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacugguaccgguccgggagcacgaucggcaaggccuucgaggcgaccgugcgcggcgccaagcggauggccguccucggggacaccgccugggacuucggcucc

SEQ ID NO: 1329 - RNA, 1353 nt, Artificial Sequence
  KU758874.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggcaagcugagcuccgggcaccugaagugccggcucaagauggacaagcugcgccugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggcgaccgugcggggcgccaagcgcauggccguccucggggacaccgccugggacuucggcucc

SEQ ID NO: 1330 - RNA, 1353 nt, Artificial Sequence
  KU729218.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacacccagacccugacgccgguggggcgccucaucaccgccaaccccgugaucaccgagagcaccgagaacuccaagaugaugcuggagcuggacccgcccuucggcgacagcuacaucgucaucggggugggcgagaagaagaucacgcaccacuggcaccgguccgggagcaccaucggcaaggccuucgaggcgaccgugcgcggcgccaagcggauggccguccucggggacaccgccugggacuucggcucc

SEQ ID NO: 1331 - RNA, 1353 nt, Artificial Sequence
  KU501217.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgagauccgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcucc

SEQ ID NO: 1332 - RNA, 1353 nt, Artificial Sequence
  KU761561.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgcccggcgcauggccguccucggggacaccgccugggacuucggcucc

SEQ ID NO: 1333 - RNA, 1353 nt, Artificial Sequence
  KY075937.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggucagcgacucccggugccccacgcagggcgaggccuaccuggacaagcagagcgacacccaguacgugugcaagcgcacccugguggaccggggcugggggaacggcugcgggcuguucggcaaggggucccuggugaccugcgccaaguucgcgugcagcaagaagaugacgggcaaguccauccagcccgagaaccuggaguaccgcaucaugcucagcguccacggcucccagcacagcgggaugaucgugaacgacaccggccacgagaccgacgagaaccgggccaaggucgagaucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcucc

SEQ ID NO: 1334 - RNA, 1353 nt, Artificial Sequence
  KY014317.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaucgagaacuccaagaugaugcuggagcuggacccgcccuucggcgacagcuacaucgucaucggggugggcgagaagaagaucacccaccacuggcaccgguccgggagcaccaucggcaaggccuucgaggcgacggugcgcggcgccaagcggauggccguccucggggacaccgccugggacuucggcucc

SEQ ID NO: 1335 - RNA, 1353 nt, Artificial Sequence
  KU870645.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucgggaucggcgagaagaagaucacccaccacuggcaccgguccgggagcacgaucggcaaggccuucgaggcgaccgugcgcggcgccaagcggauggccgugcucggggacaccgccugggacuucggcucc

SEQ ID NO: 1336 - RNA, 1353 nt, Artificial Sequence
  KU922923.1 solE CDS GC
agccagaaggugaucuaccuggucaugauccuccugaucgcccuggccuacuccauccgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacagcccccgcgccgaggcgacgcucgggggcuucggcucccuggggcuggacugcgagccgcggaccggccuggacuucuccgaccucuacuaccugaccaugaacaacaagcacuggcugguccacaaggagugguuccacgacaucccccuccccuggcacgccggggccgacaccggcacgccccacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagaucccggccgagacccugcacgggaccgugacggucgaggugcaguacgcgggcaccgacggccccugcaaggugcccgcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcucc

SEQ ID NO: 1337 - RNA, 1353 nt, Artificial Sequence
  KU497555.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggacccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcacggccgccuucaccuucaccaagauccccgccgagacccugcacgggacggugaccgucgaggugcaguacgcgggcaccgacggccccugcaaggugcccgcccagauggccgucgacaugcagacccugacgccgguggggcgccucaucaccgccaaccccgugaucaccgaguccaccgagaacagcaagaugaugcuggagcuggacccgcccuucggcgacuccuacaucgucaucggggugggcgagaagaagaucacgcaccacuggcaccggagcggguccaccaucggcaaggccuucgaggcgaccgugcgcggcgccaagcggauggccguccucggggacaccgccugggacuucggcagc

SEQ ID NO: 1338 - RNA, 1353 nt, Artificial Sequence
  KU312314.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcuggcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcucc

SEQ ID NO: 1339 - RNA, 1353 nt, Artificial Sequence
  KY014314.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggaggcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcucc

SEQ ID NO: 1340 - RNA, 1353 nt, Artificial Sequence
  KX447517.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcggcccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcucc

SEQ ID NO: 1341 - RNA, 1353 nt, Artificial Sequence
  KU729217.2 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucagcaccaccguguccaacauggccgaggugcgcagcuacugcuacgaggccaccaucuccgacaucgccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccgccgugguccuggggagccaggagggcgccgugcacaccgcccuggccggcgcgcucgaggccgagauggacggggccaagggccggcugagcuccgggcaccugaagugccgccucaagauggacaagcugcggcugaagggcgugagcuacucccucugcaccgccgccuucacguucaccaagauccccgcggagacccugcacgggaccgucacgguggagguccaguacgccggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggcguucgaggccaccgugcgcggcgccaagcggauggccgugcucggggacaccgcgugggacuucggcucc

SEQ ID NO: 1342 - RNA, 1353 nt, Artificial Sequence
  KY328290.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucagcaagauccccgccgagacccugcacgggaccgugaccgaggagguccaguacgcgggcacggacggccccugcaaggugcccgcccagauggccguggacaugcagacccugaccccggucgggcgccucaucaccgccaaccccgugaucacggaguccaccgagaacagcaagaugaugcuggagcuggacccgcccuucggcgacuccuacaucgugaucggggucggcgagaagaagaucacccaccacuggcaccggagcggguccaccaucggcaaggccuucgaggcgacggugcgcggcgccaagcggauggccgugcucggggacaccgccugggacuucggcagc

SEQ ID NO: 1343 - RNA, 1353 nt, Artificial Sequence
  KX087101.3 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgagcugcaguacgcgggcaccgacggccccugcaaggugcccgcccagauggccguggacaugcagacccucaccccggucgggcgccugaucacggccaaccccgugaucaccgagagcaccgagaacuccaagaugaugcuggagcucgacccgcccuucggcgacagcuacaucgugaucggggucggcgagaagaagaucacccaccacuggcaccgguccgggagcacgaucggcaaggccuucgaggcgaccgugcgcggcgccaagcggauggccgugcugggggacaccgccugggacuucggcucc

SEQ ID NO: 1344 - RNA, 1353 nt, Artificial Sequence
  KY003156.1 solE CDS GC
agccagaaggugaucuaccuggucaugauccuccugaucgcccccgccuacuccauccgcugcaucggcaucagcaaccgggacuucguggaggggauguccggcgggaccuggguggacgucgugcuggagcacggcgggugcgugaccgucauggcgcaggacaagcccacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcauccuggggcucgacugcgagccccggaccggccuggacuucagcgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggucccaggagggcgccgugcacaccgcccuggccggcgcccucgaggcggagauggacggggccaagggccggcugagcagcgggcaccugaagugccgccucaagauggacaagcugcggcugaagggcguguccuacagccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgagaagaagaucacccaccacuggcaccggagcggguccacgaucggcaaggccuucgaggcgaccgugcgcggcgccaagcggauggccgugcucggggacaccgccugggacuucggcagc

SEQ ID NO: 1345 - RNA, 1353 nt, Artificial Sequence
  KU758876.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggucaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcucc

SEQ ID NO: 1346 - RNA, 1353 nt, Artificial Sequence
  KU926310.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcgccgacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcucc

SEQ ID NO: 1347 - RNA, 1353 nt, Artificial Sequence
  KU681081.3 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacaccggggccgacacgggcaccccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcugagcuccgggcaccugaagugccgccucaagauggacaagcugcggcugaagggcgucagcuacucccucugcacggccgccuucaccuucaccaagauccccgccgagacccugcacgggacggugaccgucgaggugcaguacgccggcaccgacggccccugcaaggugcccgcgcagauggccgucgacaugcagacccugacgccgguggggcgccucaucaccgccaaccccgugaucaccgagggcaccgagaacagcaagaugaugcuggagcuggacccgcccuucggggacuccuacaucgucaucggcgugggggagaagaagaucacgcaccacuggcaccggagcggcuccaccaucggcaaggccuucgaggccaccgugcgcggggcgaagcggauggccguccucggcgacaccgccugggacuucgggagc

SEQ ID NO: 1348 - RNA, 1353 nt, Artificial Sequence
  KU744693.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgcgauggcccaggacaagcccacgguggacaucgagcucgugaccaccaccgucagcaacauggccgaggugcgcuccuacugcuacgaggccagcaucuccgacauggccagcgacucccggugccccacgcagggcgaggcguaccuggacaagcagagcgacacccaguacgugugcaagcgcacccuggucgaccggggcugggggaacggcugcgggcuguucggcaaggggucccuggugaccugcgccaaguucgccugcagcaagaagaugacgggcaaguccauccagcccgagaaccuggaguaccgcaucaugcucagcgugcacggcucccagcacagcgggaugcuggucaacgacaccggccacgagaccgacgagaaccgggccaagguggagaucacccccaacuccccgcgcgcggaggccacgcucgggggcuucggcagccucgggcuggacugcgagccccggaccggccuggacuucuccgaccucuacuaccugaccaugaacaacaagcacuggcuggcccacaaggagugguuccacgacaucccccuccccuggcacgccggggccgcgaccggcacgccgcacuggaacaacaaggaggcccugguggaguucaaggacgcccacgccaagcgccagaccgucguggugcuggggagccaggagggcgccguccacaccgcgcucgccggcgcccuggaggccgagauggacggggccaagggccggcugagcuccgggcaccucaagugccgccugaagauggacaagcugcggcucaagggcgugagcuacucccugugcaccgcggccuucacguucaccaagauccccgccgagaccguggacgggaccgucacgguggagggccaguacggcgggaccgacggccccugcaagguccccgcccagauggccguggacaugcagacccugaccccgguggggcgccucaucacggcgaaccccgucaucaccgagagcaccgagaacuccaagaugaugcuggagcuggacccgcccuucggcgacagcuacaucgugaucggggugggcgagaagaagaucacccaccacuggcaccgguccggcagcacgaucgggaaggccuucgaggccaccguccgcggcgccaagcggauggcggugcucggggacaccgccugggacuucggcucc

SEQ ID NO: 1349 - RNA, 1353 nt, Artificial Sequence
  EU545988.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccgccguggacaucgagcucgucacgaccaccgugagcaacauggccgaggugcgcuccuacugcuacgaggccagcaucuccgacauggccagcgacucccggugccccacccagggcgaggcguaccuggacaagcagagcgacacgcaguacgucugcaagcgcacccugguggaccggggcugggggaacggcugcgggcuguucggcaaggggucccuggugaccugcgccaaguucgccugcagcaagaagaugaccggcaaguccauccagcccgagaaccuggaguaccgcaucaugcucagcguccacggcucccagcacagcgggaugaucgugaacgacacgggccacgagaccgacgagaaccgggccaagguggagaucacccccaacuccccgcgcgcggaggccacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcucc

SEQ ID NO: 1350 - RNA, 1353 nt, Artificial Sequence
  KY007221.1 solE CDS GC
agccagaaggugaucuaccuggucaugauccuccugaucgcccccgccuacuccauccgcugcaucggcgugaacaaccgggacuucguggaggggaugagcggcgggaccugggucgacguggugcuggagcacggcgggugcgucaccgugauggcgcaggacaagcccacgguggacaucgagcucgucaccaccaccguguccaacauggccgaggugcgcagcuacugcuacgaggccuccaucagcgacauggccuccgacagccggugccccacgcagggcgaggccuaccuggacaagcaguccgacacccaguacgucugcaagcgcacccugguggaccggggcugggggaacggcugcgggcuguucggcaaggggagccuggugaccugcgcgaaguucgccugcuccaagaagaugacgggcaagagcauccagcccgagaaccuggaguaccgcaucaugcucuccguccacggcagccagcacuccgggaugaucgugaacgacaccggccacgagaccgacgagaaccgggccaagguggagaucacccccaacagcccgcgcgccgaggcgacgcucgggggcuucggcucccuggggcucgacugcgagccccggaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggucccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgaguccaccgagaacagcaagaugaugcuggagcuggacccgcccuucggcgacuccuacaucgucaucggggugggcgagaagaagaucacccaccacuggcaccggagcggguccacgaucggcaaggccuucgaggcgaccgugcgcggcgccaagcggauggccguccucggggacaccgccugggacuucggcagc

SEQ ID NO: 1351 - RNA, 1353 nt, Artificial Sequence
  KY003152.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcgccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcucc

SEQ ID NO: 1352 - RNA, 1353 nt, Artificial Sequence
  KX694533.2 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaucggccacgagaccgacgagaaccgggccaagguggagaucacccccaacuccccgcgcgccgaggcgacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcccacgcgaagcgccagacgguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucaccuucacgaagauccccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgacaagaagaucacccaccacuggcaccgguccgggagcaccaucggcaaggccuucgaggcgacggugcgcggcgccaagcggauggccguccucggggacaccgccugggacuucggcucc

SEQ ID NO: 1353 - RNA, 1353 nt, Artificial Sequence
  KX601167.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgacaagaagaucacccaccacugguaccgguccgggagcacgaucggcaaggccuucgaggcgaccgugcgcggcgccaagcggauggccguccucggggacaccgccugggacuucggcucc

SEQ ID NO: 1354 - RNA, 1353 nt, Artificial Sequence
  KY288905.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggccacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcacggccgccuucaccuucaccaagguccccgccgagacccugcacgggacggugaccguggagguccaguacgccggcaccgacggccccugcaaggugcccgcgcagauggccguggacaugcagacccugacgccggucgggcgccucaucaccgccaaccccgugaucaccgaguccaccgagaacagcaagaugaugcuggagcuggacccgcccuucggcgacuccuacaucgugaucggggucggcgacaagaagaucacgcaccacuggcaccggagcggguccaccaucggcaaggccuucgaggccaccgugcgcggcgcgaagcggauggccgugcucggggacaccgccugggacuucggcagc

SEQ ID NO: 1355 - RNA, 1353 nt, Artificial Sequence
  KF268950.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgccuucacguucaccaagguccccgccgagacccugcacgggaccgugacgguggagguccaguacgccggcaccgacggccccugcaaggugcccgcgcagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgacaagaagaucacccaccacuggcaccggagcggguccacgaucggcaaggccuucgaggccaccgugcgcggcgcgaagcggauggccgugcucggggacaccgccugggacuucggcagc

SEQ ID NO: 1356 - RNA, 1353 nt, Artificial Sequence
  KF383116.1 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgucugcacggccgccaaggugcccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggaguccaccgagaacagcaagaugaugcuggagcuggacccgcccuucggcgacuccuacaucgucaucggggugggcgacaagaagaucacccaccacuggcaccggagcggguccaccaucggcaaggccuucgaggcgacggugcgcggcgccaagcggauggccguccucggggacaccgccugggacuucggcagc

SEQ ID NO: 1357 - RNA, 1335 nt, Artificial Sequence
  KU963574.2 solE CDS GC
agccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacagcggcgcggacaccgagaccccgcacuggaacaacaaggaggcccucguggaguucaaggacgcccacgccaagcgccagacggucguggugcuggggagccaggagggcgccguccacaccgcgcuggccggggcccucgaggccgagauggacggcgccaagggccggcuguccagcgggcaccugaagugccgccucaagauggacaagcugcggcugaagggcguguccuacagccucugcaccgcggccuucaccuucacgaagguccccgccgagacccugcacgggaccgugaccguggagguccaguacgccggccgcgacgggcccugcaaggugcccgcccagauggcgguggacaugcagacgcugaccccggucggccggcucaucaccgccaaccccgugaucaccgaguccacggagaacagcaagaugaugcuggagcuggacccgcccuucggcgacuccuacaucgugaucggggucggcgacaagaagaucacccaccacuggcaccgcagcggguccaucaucggcaaggccuucgaggccaccgugcgcggggccaagcggauggcggugcucggcgacaccgccugggacuucggcagc

SEQ ID NO: 1358 - RNA, 1353 nt, Artificial Sequence
  KF383118.1 solE CDS GC
agccagaaggugaucuaccuggucaugaucgugcucaucgugcccgccuacuccaucagcugcaucggcgucuccaaccgcgaccugguggaggggaugagcggcgggaccuggguggacgucgugcuggagcacggcgggugcgugaccgagauggcccaggacaagcccacggucgacaucgagcucgugaccaugaccguguccaacauggcggagguccggagcuacugcuacgaggccucccugagcgacauggccuccgccagccgcugccccacccagggcgagcccucccuggacaagcagagcgacacgcaguccgugugcaagcggacccucggcgaccgcggguggggcaacgggugcggcaucuucgggaagggcagccuggugaccugcuccaaguucacgugcugcaagaagaugcccggcaagagcauccagccggagaaccuggaguaccggaucaugcuccccguccacgggucccagcacagcggcaugaucgugaacgacaucgggcacgagaccgacgagaaccgcgccaagguggaggucacccccaacagcccccgggcggaggccacccugggcggcuucgggucccugggccucgacugcgagccgcgcaccgggcuggacuucagcgaccuguacuaccucacgaugaacaacaagcacuggcuggugcacaaggagugguuccacgacaucccccugcccuggcacgccggcgccgacaccgggacgccccacuggaacaacaaggaggcgcucguggaguucaaggacgcccacgccaagcggcagaccgucguggugcugggcucccaggagggcgccguccacaccgcccuggcgggggcccucgaggccgagauggacggcgccaaggggcgccuguucagcggccaccugaagugccggcucaagauggacaagcugcgccugaaggggguguccuacagccucugcaccgccgcguucaccuucaccaaggucccggccgagacgcugcacggcaccgugaccguggagguccaguccgccggcaccgacgggcccugcaaggugcccgcccagauggccguggacaugcagacgcugacccccgucggccggcucaucaccgcgaacccggugaucaccgagagcacggagaacuccaagaugaugcuggagcuggacccgcccuucggggacagcuacaucgugaucggcgucggggacaagaagaucacccaccacuggcaccgcuccggcagcaccaucggcaaggccuucgaggccaccgugcgcggggccaagcggauggccgugcucggcgacacggcgugggacuucgggucc

SEQ ID NO: 1359 - RNA, 1353 nt, Artificial Sequence
  KX520666.1 solE CDS GC
cgccagaaggugaucuaccuggucaugauccuccugaucgcccccgccuacagcauccggugcaucggcguguccaaccgcgacuucguggaggggaugagcggcgggaccugggucgacguggugcuggagcacggcgggugcgucaccgugauggcgcaggacaagcccacgguggacaucgagcucgucaccaccaccguguccaacauggccgaggugcggagcuacugcuacgaggccuccaucagcgacauggccuccgacagccgcugccccacgcagggcgaggccuaccuggacaagcaguccgacacccaguacgucugcaagcggacccugguggaccgcggcugggggaacggcugcgggcuguucggcaaggggagccuggugaccugcgcgaaguucgccugcuccaagaagaugacgggcaagagcauccagcccgagaaccuggaguaccggaucaugcucuccguccacggcagccagcacuccgggaugaucgugaacgacaccggccacgagaccgacgagaaccgcgccaagguggagaucacccccaacagcccgcgggccgaggcgacgcucgggggcuucggcucccuggggcucgacugcgagccccgcaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcggcagaccguggucgugcuggggucccaggagggcgccgugcacaccgcccuggccggcgcccucgaggcggagauggacggggccaagggccgccugagcagcgggcaccugaagugccggcucaagauggacaagcugcgccugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgaguccaccgagaacagcaagaugaugcuggagcuggacccgcccuucggcgacuccuacaucgucaucggggugggcgagaagaagaucacccaccacuggcaccgcagcggguccacgaucggcaaggccuucgaggcgaccgugcggggcgccaagcgcauggccguccucggggacaccgccugggacuucggcagc

SEQ ID NO: 1360 - RNA, 1353 nt, Artificial Sequence
  KF383120.1 solE CDS GC
agccagcgcgugaucuaccuggucaugauccuccugaucgcccccgccuacuccauccggugcaucggcgugagcaaccgcgacuucguggaggggauguccggcgggaccugggucgacguggugcuggagcacggcgggugcgucaccgugauggcgcaggacaagcccacgguggacaucgagcucgucaccaccaccgugagcaacauggccgaggugcgguccuacugcuacgaggccagcaucuccgacauggccagcgacucccgcugccccacgcagggcgaggccuaccuggacaagcagagcgacacccaguacgucugcaagcggacccugguggaccgcggcugggggaacggcugcgggcuguucggcaaggggucccuggugaccugcgcgaaguucacgugcagcaagaagaugaccggcaaguccauccagcccgagaaccuggaguaccggaucaugcucagcguccacggcucccagcacagcgggaugaucgugaacgacaucggccacgagaccgacgagaaccgcgccaagguggaggucacccccaacuccccgcgggccgaggccacgcucgggggcuucggcagccuggggcucgacugcgagccccgcaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcggcagaccgucguggugcuggggagccaggagggcgcgguccacaccgcccuggccggcgcccucgaggccgagauggacggggcgaagggccgccuguucagcgggcaccugaagugccggaucaagauggacaagcuccgccugaagggcguguccuacagccugugcaccgccgccuucacguucuccaagguccccgccgagacccuccacgggaccgugaccguggagguccaguacgccggccgggacggccccugcaaggugcccgcgcagauggccguggacaugcagacgcugaccccggucgggcgccugaucaccgccaaccccaucaucaccgagagcacggagaacucccggaugaugcucgagcuggacccgcccuucggcgacagcuacaucgugaucggggugggcgacaagaagaucacccaccacuggcaccgcuccgggagcaccaucggcaaggccuucgaggccaccguccggggcgcgaagcgcauggccgugcugggggacacggccugggacuucggcucc

SEQ ID NO: 1361 - RNA, 2136 nt, Artificial Sequence
  ZIKV (strain ZikaSPH2015) Polyprotein(93-804) CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1362 - RNA, 2136 nt, Artificial Sequence
  ZIKV (isolate Z1106033) Polyprotein(93-804) CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaag

SEQ ID NO: 1363 - RNA, 2124 nt, Artificial Sequence
  ZIKV (strain MR 766) Polyprotein(93-800) CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1364 - RNA, 2136 nt, Artificial Sequence
  ZIKV (strain NatalRGN) Polyprotein(93-804) CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1365 - RNA, 2061 nt, Artificial Sequence
  ZIKV (strain ZikaSPH2015) Polyprotein(108-794) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1366 - RNA, 2061 nt, Artificial Sequence
  ZIKV (isolate Z1106033) Polyprotein(108-794) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 1367 - RNA, 2049 nt, Artificial Sequence
  ZIKV (strain MR 766) Polyprotein(108-790) CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1368 - RNA, 2061 nt, Artificial Sequence
  ZIKV (strain NatalRGN) Polyprotein(108-794) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1369 - RNA, 1353 nt, Artificial Sequence
  ZIKV (strain ZikaSPH2015) Polyprotein(273-723) CDS opt
ucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1370 - RNA, 1353 nt, Artificial Sequence
  ZIKV (isolate Z1106033) Polyprotein(273-723) CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1371 - RNA, 1341 nt, Artificial Sequence
  ZIKV (strain MR 766) Polyprotein(273-719) CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1372 - RNA, 1353 nt, Artificial Sequence; identical to SEQ ID NO: 1370
  ZIKV (strain NatalRGN) Polyprotein(273-723) CDS opt

SEQ ID NO: 1373 - RNA, 2061 nt, Artificial Sequence
  ZIKV (strain ZikaSPH2015) Polyprotein(108-794)(F398S) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1374 - RNA, 2061 nt, Artificial Sequence
  ZIKV (isolate Z1106033) Polyprotein(108-794)(F398S) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 1375 - RNA, 2049 nt, Artificial Sequence
  ZIKV (strain MR 766) Polyprotein(108-790)(F398S) CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1376 - RNA, 2061 nt, Artificial Sequence
  ZIKV (strain NatalRGN) Polyprotein(108-794)(F398S) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1377 - RNA, 2061 nt, Artificial Sequence
  ZIKV (strain ZikaSPH2015) Polyprotein(108-794)(N444Q) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1378 - RNA, 2061 nt, Artificial Sequence
  ZIKV (isolate Z1106033) Polyprotein(108-794)(N444Q) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 1379 - RNA, 2061 nt, Artificial Sequence
  ZIKV (strain NatalRGN) Polyprotein(108-794)(N444Q) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1380 - RNA, 2061 nt, Artificial Sequence
  ZIKV (strain ZikaSPH2015) Polyprotein(108-694)-Cterm-JAEV1-E(400-500) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 1381 - RNA, 2061 nt, Artificial Sequence
  ZIKV (isolate Z1106033) Polyprotein(108-694)-Cterm-JAEV1-E(400-500) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 1382 - RNA, 2049 nt, Artificial Sequence
  ZIKV (strain MR 766) Polyprotein(108-690)-Cterm-JAEV1-E(400-500) CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 1383 - RNA, 2061 nt, Artificial Sequence
  ZIKV (strain NatalRGN) Polyprotein(108-694)-Cterm-JAEV1-E(400-500) CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 1384 - RNA, 2136 nt, Artificial Sequence; identical to SEQ ID NO: 1361
  ZIKV (strain ZikaSPH2015) Polyprotein(93-804) CDS opt

SEQ ID NO: 1385 - RNA, 2133 nt, Artificial Sequence
  ZIKV prME variant CDS opt
aucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1386 - RNA, 2130 nt, Artificial Sequence
  ZIKV prME variant CDS opt
aucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1387 - RNA, 2127 nt, Artificial Sequence
  ZIKV prME variant CDS opt
aacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1388 - RNA, 2124 nt, Artificial Sequence
  ZIKV prME variant CDS opt
gcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1389 - RNA, 2121 nt, Artificial Sequence
  ZIKV prME variant CDS opt
cgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1390 - RNA, 2118 nt, Artificial Sequence
  ZIKV prME variant CDS opt
aaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1391 - RNA, 2115 nt, Artificial Sequence
  ZIKV prME variant CDS opt
gagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1392 - RNA, 2112 nt, Artificial Sequence
  ZIKV prME variant CDS opt
aagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1393 - RNA, 2109 nt, Artificial Sequence
  ZIKV prME variant CDS opt
aagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1394 - RNA, 2106 nt, Artificial Sequence
  ZIKV prME variant CDS opt
cgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1395 - RNA, 2103 nt, Artificial Sequence
  ZIKV prME variant CDS opt
cgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1396 - RNA, 2100 nt, Artificial Sequence
  ZIKV prME variant CDS opt
ggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1397 - RNA, 2097 nt, Artificial Sequence
  ZIKV prME variant CDS opt
gccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1398 - RNA, 2094 nt, Artificial Sequence
  ZIKV prME variant CDS opt
gacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1399 - RNA, 2091 nt, Artificial Sequence
  ZIKV prME variant CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1400 - RNA, 2091 nt, Artificial Sequence
  ZIKV prME variant CDS opt
accuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1401 - RNA, 2103 nt, Artificial Sequence
  ZIKV prME variant CDS opt
cgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1402 - RNA, 2127 nt, Artificial Sequence
  ZIKV prME variant CDS opt
cgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1403 - RNA, 2127 nt, Artificial Sequence
  ZIKV prME variant CDS opt
cgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1404 - RNA, 2118 nt, Artificial Sequence
  ZIKV prME variant CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1405 - RNA, 2115 nt, Artificial Sequence
  ZIKV prME variant CDS opt
aucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1406 - RNA, 2112 nt, Artificial Sequence
  ZIKV prME variant CDS opt
aucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1407 - RNA, 2109 nt, Artificial Sequence
  ZIKV prME variant CDS opt
aacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1408 - RNA, 2106 nt, Artificial Sequence
  ZIKV prME variant CDS opt
gcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1409 - RNA, 2103 nt, Artificial Sequence
  ZIKV prME variant CDS opt
cgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1410 - RNA, 2100 nt, Artificial Sequence
  ZIKV prME variant CDS opt
aaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1411 - RNA, 2097 nt, Artificial Sequence
  ZIKV prME variant CDS opt
gagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1412 - RNA, 2094 nt, Artificial Sequence
  ZIKV prME variant CDS opt
aagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1413 - RNA, 2091 nt, Artificial Sequence
  ZIKV prME variant CDS opt
aagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1414 - RNA, 2088 nt, Artificial Sequence
  ZIKV prME variant CDS opt
cgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1415 - RNA, 2085 nt, Artificial Sequence
  ZIKV prME variant CDS opt
cgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1416 - RNA, 2082 nt, Artificial Sequence
  ZIKV prME variant CDS opt
ggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1417 - RNA, 2079 nt, Artificial Sequence
  ZIKV prME variant CDS opt
gccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1418 - RNA, 2076 nt, Artificial Sequence
  ZIKV prME variant CDS opt
gacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1419 - RNA, 2073 nt, Artificial Sequence
  ZIKV prME variant CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1420 - RNA, 2073 nt, Artificial Sequence
  ZIKV prME variant CDS opt
accuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1421 - RNA, 2085 nt, Artificial Sequence
  ZIKV prME variant CDS opt
cgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1422 - RNA, 2109 nt, Artificial Sequence
  ZIKV prME variant CDS opt
cgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1423 - RNA, 2109 nt, Artificial Sequence
  ZIKV prME variant CDS opt
cgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugc

SEQ ID NO: 1424 - RNA, 2109 nt, Artificial Sequence
  ZIKV prME variant CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1425 - RNA, 2106 nt, Artificial Sequence
  ZIKV prME variant CDS opt
aucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1426 - RNA, 2103 nt, Artificial Sequence
  ZIKV prME variant CDS opt
aucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1427 - RNA, 2100 nt, Artificial Sequence
  ZIKV prME variant CDS opt
aacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1428 - RNA, 2097 nt, Artificial Sequence
  ZIKV prME variant CDS opt
gcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1429 - RNA, 2094 nt, Artificial Sequence
  ZIKV prME variant CDS opt
cgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1430 - RNA, 2091 nt, Artificial Sequence
  ZIKV prME variant CDS opt
aaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1431 - RNA, 2088 nt, Artificial Sequence
  ZIKV prME variant CDS opt
gagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1432 - RNA, 2085 nt, Artificial Sequence
  ZIKV prME variant CDS opt
aagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1433 - RNA, 2082 nt, Artificial Sequence
  ZIKV prME variant CDS opt
aagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1434 - RNA, 2079 nt, Artificial Sequence
  ZIKV prME variant CDS opt
cgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1435 - RNA, 2076 nt, Artificial Sequence
  ZIKV prME variant CDS opt
cgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1436 - RNA, 2073 nt, Artificial Sequence
  ZIKV prME variant CDS opt
ggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1437 - RNA, 2070 nt, Artificial Sequence
  ZIKV prME variant CDS opt
gccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1438 - RNA, 2067 nt, Artificial Sequence
  ZIKV prME variant CDS opt
gacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1439 - RNA, 2064 nt, Artificial Sequence
  ZIKV prME variant CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1440 - RNA, 2064 nt, Artificial Sequence
  ZIKV prME variant CDS opt
accuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1441 - RNA, 2076 nt, Artificial Sequence
  ZIKV prME variant CDS opt
cgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1442 - RNA, 2100 nt, Artificial Sequence
  ZIKV prME variant CDS opt
cgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1443 - RNA, 2100 nt, Artificial Sequence
  ZIKV prME variant CDS opt
cgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgac

SEQ ID NO: 1444 - RNA, 2106 nt, Artificial Sequence
  ZIKV prME variant CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1445 - RNA, 2100 nt, Artificial Sequence
  ZIKV prME variant CDS opt
aucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1446 - RNA, 2103 nt, Artificial Sequence
  ZIKV prME variant CDS opt
aucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1447 - RNA, 2097 nt, Artificial Sequence
  ZIKV prME variant CDS opt
aacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1448 - RNA, 2094 nt, Artificial Sequence
  ZIKV prME variant CDS opt
gcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1449 - RNA, 2091 nt, Artificial Sequence
  ZIKV prME variant CDS opt
cgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1450 - RNA, 2088 nt, Artificial Sequence
  ZIKV prME variant CDS opt
aaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1451 - RNA, 2085 nt, Artificial Sequence
  ZIKV prME variant CDS opt
gagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1452 - RNA, 2082 nt, Artificial Sequence
  ZIKV prME variant CDS opt
aagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1453 - RNA, 2079 nt, Artificial Sequence
  ZIKV prME variant CDS opt
aagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1454 - RNA, 2076 nt, Artificial Sequence
  ZIKV prME variant CDS opt
cgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1455 - RNA, 2073 nt, Artificial Sequence
  ZIKV prME variant CDS opt
cgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1456 - RNA, 2070 nt, Artificial Sequence
  ZIKV prME variant CDS opt
ggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1457 - RNA, 2067 nt, Artificial Sequence
  ZIKV prME variant CDS opt
gccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1458 - RNA, 2064 nt, Artificial Sequence
  ZIKV prME variant CDS opt
gacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1459 - RNA, 2061 nt, Artificial Sequence; identical to SEQ ID NO: 1365
  ZIKV (strain ZikaSPH2015) Polyprotein(108-794) CDS opt

SEQ ID NO: 1460 - RNA, 2061 nt, Artificial Sequence
  ZIKV prME variant CDS opt
accuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1461 - RNA, 2073 nt, Artificial Sequence
  ZIKV prME variant CDS opt
cgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1462 - RNA, 2097 nt, Artificial Sequence
  ZIKV prME variant CDS opt
cgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1463 - RNA, 2097 nt, Artificial Sequence
  ZIKV prME variant CDS opt
cgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1464 - RNA, 2136 nt, Artificial Sequence; identical to SEQ ID NO: 1361
  KU321639.1 prME-long CDS opt

SEQ ID NO: 1465 - RNA, 2136 nt, Artificial Sequence; identical to SEQ ID NO: 1362
  KU312312.1 prME-long CDS opt

SEQ ID NO: 1466 - RNA, 2124 nt, Artificial Sequence; identical to SEQ ID NO: 1363
  AY632535.2 prME-long CDS opt

SEQ ID NO: 1467 - RNA, 2136 nt, Artificial Sequence; identical to SEQ ID NO: 1364
  KU527068.1 prME-long CDS opt

SEQ ID NO: 1468 - RNA, 2136 nt, Artificial Sequence
  KU720415.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1469 - RNA, 2118 nt, Artificial Sequence
  DQ859059.1 prME-long CDS opt
cgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1470 - RNA, 2136 nt, Artificial Sequence
  KX377335.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1471 - RNA, 2136 nt, Artificial Sequence
  LC002520.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1472 - RNA, 2124 nt, Artificial Sequence
  KU963573.2 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1473 - RNA, 2136 nt, Artificial Sequence
  KX694534.2 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1474 - RNA, 2136 nt, Artificial Sequence
  KX447520.1 prME-long CDS opt
cgcaucaucaacgcccgcaaggagaagaagcgccgcggcgccgacgccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1475 - RNA, 2136 nt, Artificial Sequence
  KX369547.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1476 - RNA, 2136 nt, Artificial Sequence
  KX447515.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1477 - RNA, 2136 nt, Artificial Sequence
  KU501217.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1478 - RNA, 2136 nt, Artificial Sequence
  KU312314.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1479 - RNA, 2136 nt, Artificial Sequence
  KX446950.2 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1480 - RNA, 2136 nt, Artificial Sequence
  KY003157.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccgacgucggcugcuccgucgacuucuccaag

SEQ ID NO: 1481 - RNA, 2136 nt, Artificial Sequence
  KX811222.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1482 - RNA, 2136 nt, Artificial Sequence
  KX447516.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1483 - RNA, 2136 nt, Artificial Sequence
  KX520666.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1484 - RNA, 2136 nt, Artificial Sequence
  KU729218.1 prME-long CDS opt
cgcaucaucaacgcccgcaaggagaagaagcgccgcuccgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1485 - RNA, 2136 nt, Artificial Sequence
  KU761561.1 prME-long CDS opt
cgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1486 - RNA, 2136 nt, Artificial Sequence
  KY317938.1 prME-long CDS opt
cgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1487 - RNA, 2136 nt, Artificial Sequence
  KY075939.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1488 - RNA, 2136 nt, Artificial Sequence
  KX806557.2 prME-long CDS opt
cgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1489 - RNA, 2136 nt, Artificial Sequence
  KU870645.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1490 - RNA, 2136 nt, Artificial Sequence
  KU729217.2 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1491 - RNA, 2136 nt, Artificial Sequence
  KU497555.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1492 - RNA, 2136 nt, Artificial Sequence
  KX087101.3 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1493 - RNA, 2136 nt, Artificial Sequence
  KY075932.1 prME-long CDS opt
cgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1494 - RNA, 2136 nt, Artificial Sequence
  KY014317.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1495 - RNA, 2136 nt, Artificial Sequence
  KU758876.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccgacgucggcugcuccgucgacuucuccaag

SEQ ID NO: 1496 - RNA, 2136 nt, Artificial Sequence
  KU758874.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1497 - RNA, 2136 nt, Artificial Sequence
  KY014314.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1498 - RNA, 2136 nt, Artificial Sequence
  KU926310.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1499 - RNA, 2136 nt, Artificial Sequence
  KU761560.1 prME-long CDS opt
cgcaucaucaacgccggcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1500 - RNA, 2136 nt, Artificial Sequence
  KY317939.1 prME-long CDS opt
cgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1501 - RNA, 2136 nt, Artificial Sequence
  KY075937.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1502 - RNA, 2136 nt, Artificial Sequence
  LC191864.1 prME-long CDS opt
cgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1503 - RNA, 2136 nt, Artificial Sequence
  KX447517.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1504 - RNA, 2136 nt, Artificial Sequence
  KU922923.1 prME-long CDS opt
cgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1505 - RNA, 2136 nt, Artificial Sequence
  KY003156.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1506 - RNA, 2136 nt, Artificial Sequence
  KU312313.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaag

SEQ ID NO: 1507 - RNA, 2136 nt, Artificial Sequence
  KY075935.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1508 - RNA, 2136 nt, Artificial Sequence
  KY014320.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1509 - RNA, 2136 nt, Artificial Sequence
  KX827309.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1510 - RNA, 2136 nt, Artificial Sequence
  KU681081.3 prME-long CDS opt
cgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1511 - RNA, 2136 nt, Artificial Sequence
  KU744693.1 prME-long CDS opt
cgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcggcgucggcugcuccgucgacuucuccaag

SEQ ID NO: 1512 - RNA, 2136 nt, Artificial Sequence
  KY328290.1 prME-long CDS opt
cgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1513 - RNA, 2136 nt, Artificial Sequence
  KX694532.2 prME-long CDS opt
cgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaag

SEQ ID NO: 1514 - RNA, 2136 nt, Artificial Sequence
  KU955593.1 prME-long CDS opt
cgcaucaucaacgcccgcaaggagaagaagcgccgcggcaccgacaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccgacgucggcugcuccgucgacuucuccaag

(The sequence listing continues in the following parts.)

---

The invention claimed is:

1. An artificial nucleic acid comprising at least one coding region encoding at least one polypeptide comprising Zika virus envelope protein (E), wherein the artificial nucleic acid is a mRNA comprising, in 5' to 3' direction, the following elements:
   a) a 5'-CAP structure,
   b) the at least one coding region comprising a modified nucleic acid sequence encoding the at least one polypeptide comprising Zika virus envelope protein (E), wherein the at least one polypeptide comprises an amino acid sequence at least 95% identical to SEQ ID NO: 552, wherein the at least one coding region comprises a nucleic acid sequence identical to the polypeptide coding region of SEQ ID NO: 5520 or a sequence at least 95% identical to the polypeptide coding region of SEQ ID NO: 5520,
   c) a heterologous 3'-UTR element comprising a nucleic acid sequence, and
   d) a poly(A) sequence comprising 10 to 200 adenosine nucleotides.

2. The artificial nucleic acid according to claim 1, further comprising
   at least one heterologous 5' untranslated region (UTR) element.

3. The artificial nucleic acid according to claim 1, wherein the artificial nucleic acid comprises at least one histone stem-loop.

4. The artificial nucleic acid according to claim 1, wherein the at least one encoded polypeptide comprises at least one signal sequence.

5. The artificial nucleic acid according to claim 1, wherein the G/C content of the at least one coding region is increased compared to the G/C content of a reference RNA encoding the at least one polypeptide.

6. The artificial nucleic acid according to claim 1, wherein the at least one heterologous 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene.

7. The artificial nucleic acid according to claim 2, wherein the at least one heterologous 5'-UTR element comprises a nucleic acid sequence, which is derived from the 5'-UTR of a TOP gene.

8. A composition comprising at least one artificial nucleic acid as defined by claim 1 and a pharmaceutically acceptable carrier.

9. The composition according to claim 8, wherein the at least one artificial nucleic acid is complexed at least partially with a cationic or polycationic compound and/or a polymeric carrier.

10. A kit or kit of parts comprising the artificial nucleic acid according to claim 1, optionally a liquid vehicle for solubilising, and optionally technical instructions providing information on administration and dosage of the components.

11. A method of treating a subject with, or protecting a subject from, an infection with Zika virus or a disorder related to an infection with Zika virus comprising administering to said subject the artificial nucleic acid according to claim 1.

12. The artificial nucleic acid according to claim 1, wherein the at least one polypeptide comprises a stem region of the Japanese encephalitis virus E protein.

13. The artificial nucleic acid according to claim 1, wherein the modified nucleic acid sequence comprises a nucleotide with a base modification selected from pseudouridine or 1-methyl-pseudouridine.

14. The artificial nucleic acid according to claim 1, wherein the at least one polypeptide comprises the amino acid sequence according to SEQ ID NO: 552.

15. The artificial nucleic acid according to claim 14, wherein the coding region comprises a modified nucleic acid sequence that comprises a nucleotide with a base modification selected from pseudouridine or 1-methyl-pseudouridine.

* * * * *